United States Patent 11,446,398 (REGULATED BIOCIRCUIT SYSTEMS) - sequence listing, part 56

SEQ ID NO: 150280 - DNA, 4259 bp, Homo sapiens
  Payload ID: 9672
  Gene Symbol: LYSMD3
  Gene Name: LysM, putative peptidoglycan-binding, domain containing 3
  Uniprot ID: Q7Z3D4
  ENST ID: ENST00000315948
  CDS Start-End: 146-1066
gacgttggcggcagaggcggaggcggacggggtcagcccaaagcagaggctcggccatgaacttacccgggacagcggcggcggcggaccttttggccatcttctcgcagagtgctccctgctaacggggacagattttaacattatggcagggaggcatcagaatcgtagttttcctcttccaggagttcagtcaagtggtcaagtacatgcatttggaaattgttcagacagtgatattttggaggaggatgctgaagtgtatgaacttcgatccagaggaaaagagaaagtccgaagaagtacatcaagagatagacttgacgacattatagtattaacaaaagatatacaagaaggagatacattaaatgcaatagcccttcagtactgttgtacggtagcagatatcaagagagttaacaatctcatcagtgatcaagacttttttgcccttaggtctatcaaaattccagtaaaaaagttcagttccttgaccgaaacactttgtcctccaaaaggaagacagacttcacgtcattcatctgttcaatactcttccgaacaacaggaaattttgccagctaatgattctcttgcttacagtgactcagctggtagctttttaaaagaagtagaccgagacatagaacaaatagtaaagtgtacagacaataagagagagaacctcaatgaggtagtatcggccttaacagcacaacaaatgcgttttgaacctgataacaaaaacactcaacgtaaagacccctattatggagcagactggggaatagggtggtggacagctgtagtgataatgttgatagtaggtataataacaccagtgttttatttgttgtattatgaaattttagctaaggtggatgttagtcatcattcaacagtggactcttcacatttacattcaaaaatcacacccccatcacagcagagagaaatggaaaatggaattgtgccaactaaaggaatacatttcagccaacaagatgatcataaactgtatagtcaagattctcagtcacctgctgctcaacaggaaacatagcaattagctcataatcaaatgttagtggtcacatgtgcatctggaatgtggtgaatcagttatatccaataatagcttcaaaggcagaatttagagagattgaggatgcttttgtttttaacaaaagggtttcacactttgaaaattttttgagcaactagttgttgatgttgagagcagttgatccataaatctggtgtgtgaatgtttcaagcagaaattaatttaaatgtgtgtttaggaagtacttaacttggaagatgtatcatttttcttaaaatgcatgtttaaattttatttttttaagtaatttttaaaaagtttattaatgttaaatttatgatgcagaatgatagcatcagatgtctgcagctgaaaaaaatttactactatgaacccccaaaatattcagttgcaagaaaatttgattctaaaattattcatggtaggatacgtaacacaccccttcaaaacttttaaaaaatacatttagcacatgtgctatgaaagcatacgtacaaagagaaaggggaaagtgatttataattcctacaacagaggccaagaaatagattaaaatattttcaagaccccaaaataatgtattatggttgggaagtcagtagaacactggaataggtgaagacctgacagtaatttttgtcttaagaatgctttctttaggacagaccctttaacctcacctctgtgcatctgtttttaaaatgattatatttgcctctgatatttgaaagcacttttgtagttttgatgatgaaaaatatattaaacgtgcatattaccattatttaggaaataattccttatatactgtgataaatcattgctgttacatacagtaacatgccttaattacatttaatgccttactgctttatgtaagtaaatccaagtttcagaattaaaaataagcattatttcatatggtccaatcagattcgttacataggctatataaatttgtctccattttcaccatcaagcacaaataattgggtcaaaactgcctttgaggtctgttgaagaaaatggttcattaagcaaaaaagagtagaggtattttatattagcagtaacagacaaattatttagtaatcccttaacctctgtttttcaaagagaaaatatccaatttagacttttttcctgatctctatatatagcatcaaattgggaaacaaaggccaaaggtgtatagattgcttgaaagggggtggtagtgcctctttttaagatctgttgagtcggctacagtctggctaagtaagaagcatttgcatactgattccatcatttaatctttaaaagtatgtgttttaaaaatgtaaccagaatgattcttcaatagaaatgagatttggtggagtctggattgcctgttttgtatataatatatacttaagatatataataccacctcattttctgggcattatttcctaattgttgatgtttcaggcttttgataagtcattttatatatttcaaatttaactcagaataagtaaatatttatggcaaatgcagttttatgtactttcaggagaagaccatcaggaaaagacaggacaaagaagtcaaacattaaagcccttgcaaatattagaggaccttagacaattaccaaaaagtgtttaatagggaagttgcaaatgattctcttagtaaattaaacatttaaaaagtagttttaatgtgccttgggcatcttgaaaagaagagtgtgatataatttatgcttagtgttaactggtcattttacattgtatttattaagtctgctgaaaaatgaggttttaaggaagaaaatgcagattattttagggtaaacaggccaggtgtcctttgaagaactttgtttacatcaaattgatgaaattacagtcagtgattccttactttttttgctagttgtactttgaaattgttatgggttcgatttccaaaatatgtaacttattttttaaaggaataaggtgtgctgtgtatttgttgattaaaaatcatttgtcttgcagagtatccttttttgaaggaaatatacatccttataacacatcaggtagttttcttttttctgtatttaaattatatatttgaattaattgaatataatttgagttacatataattctatataaaggttacatattgaattatggttctaatctgtttaggaaagaaatgaattttctaagcatttaatacatttggaataattttagtttctaaaaagtactaatgtaagttaagtttatatcaaatgcaaattaccttgtataactaacaagcacagttattgtttaacattatggattttaattgtgttgacacccttctttgaatttgttgctttacatgtgtgtctgtgtgtgtgtctgcatgtgtgcacgcatgtacttgtatgcaatgtaaaagtaacagcagaatcattgcatttggtttacttaaaattttggagttagcaagtaaacaaaaagctgatagttttatgaagtctcggttaaaataaaatttctttgctatctcactcctaggaagttatggagttcatattttcaaaagatatgttaaaaatggttacacactctgctggccacattaaaaattagaagactcatgttaaattatctcctccaaaggactttttatttacagcttttcttttcctggactctacctgcttggttcagtgtcctgaagagttatttaaatgaaccactacttagtaattagttcttttttaaagtatctacttctaaaattacctagttgaaaatatgaaggatatgcttagttttagaaatatcatgaagcaaggatctagtcagtgttacagggtaaaggtggagttttttaaagtctgtatttaaatggtgcactgatggattcatttttaatttgcattacaaaaatgttgctcaggtaatcagtattttcttccacgtatgtgcatattgcactgttagatcatagaaatatctgaatgctttaatttttatgtatgcaaaatctataaatcttttgtataatgtattttatacaaatgtaactgtagaacattgttagcatgtgtatctgtaaaaccagtttttaaaattttttgccccttatttttcatattttgaaagatctccaacatgtaataaagtttctcttattcaatctaaaa

SEQ ID NO: 150281 - DNA, 553 bp, Homo sapiens
  Payload ID: 9672
  Gene Symbol: LYSMD3
  Gene Name: LysM, putative peptidoglycan-binding, domain containing 3
  ENST ID: ENST00000453259
  CDS Start-End: 149-421
ggagacgttggcggcagaggcggaggcggacggggtcagcccaaagcagaggctcggccatgaacttacccgggacagcggcggcggcggaccttttggccatcttctcgcagagtgctccctgctaacggggacagattttaacattatggcagggaggcatcagaatcgtagttttcctcttccaggagttcagtcaagtggtcaagtacatgcatttggaaattgttcagacagtgatattttggaggaggatgctgaagtgtatgaacttcgatccagaggaaaagagaaagtccgaagaagtacatcaagagatagacttgacgacattatagtattaacaaaagatatacaagaaggagatacattaaatgcaatagcccttcagtactgttgtacgtgttccatttctcaatgaatgccatcgtccatcaagttgaccaaaccagaaatctaagcttcatactagacccactttatctctctgacatgaatcaggtagcagatatcaagagagttaacaatctcatcagtgatcaagacttttttg

SEQ ID NO: 150282 - DNA, 3863 bp, Homo sapiens
  Payload ID: 9672
  Gene Symbol: LYSMD3
  Gene Name: LysM, putative peptidoglycan-binding, domain containing 3
  Uniprot ID: Q7Z3D4
  ENST ID: ENST00000500869
  CDS Start-End: 210-662
aggcggacggggtcagcccaaagcagaggctcggccatgaacttacccgggacagcggcggcggcggaccttttggccatcttctcgcagagtgctccctgctaacggggacaggctgatttcctttcaccaagatactgaattttggacttcttcaaggctcagtcttggaccctcttctttttctatactctctagattttaacattatggcagggaggcatcagaatcgtagttttcctcttccaggagttcagtcaagtggtcaagtacatgcatttggaaattgttcagacagtgatattttggaggaggatgctgaagtgtatgaacttcgatccagaggaaaagagaaagtccgaagaagtacatcaagagatagacttgacgacattatagtattaacaaaagatatacaagaaggagatacattaaatgcaatagcccttcagtactgttgtacgctaaggtggatgttagtcatcattcaacagtggactcttcacatttacattcaaaaatcacacccccatcacagcagagagaaatggaaaatggaattgtgccaactaaaggaatacatttcagccaacaagatgatcataaactgtatagtcaagattctcagtcacctgctgctcaacaggaaacatagcaattagctcataatcaaatgttagtggtcacatgtgcatctggaatgtggtgaatcagttatatccaataatagcttcaaaggcagaatttagagagattgaggatgcttttgtttttaacaaaagggtttcacactttgaaaattttttgagcaactagttgttgatgttgagagcagttgatccataaatctggtgtgtgaatgtttcaagcagaaattaatttaaatgtgtgtttaggaagtacttaacttggaagatgtatcatttttcttaaaatgcatgtttaaattttatttttttaagtaatttttaaaaagtttattaatgttaaatttatgatgcagaatgatagcatcagatgtctgcagctgaaaaaaatttactactatgaacccccaaaatattcagttgcaagaaaatttgattctaaaattattcatggtaggatacgtaacacaccccttcaaaacttttaaaaaatacatttagcacatgtgctatgaaagcatacgtacaaagagaaaggggaaagtgatttataattcctacaacagaggccaagaaatagattaaaatattttcaagaccccaaaataatgtattatggttgggaagtcagtagaacactggaataggtgaagacctgacagtaatttttgtcttaagaatgctttctttaggacagaccctttaacctcacctctgtgcatctgtttttaaaatgattatatttgcctctgatatttgaaagcacttttgtagttttgatgatgaaaaatatattaaacgtgcatattaccattatttaggaaataattccttatatactgtgataaatcattgctgttacatacagtaacatgccttaattacatttaatgccttactgctttatgtaagtaaatccaagtttcagaattaaaaataagcattatttcatatggtccaatcagattcgttacataggctatataaatttgtctccattttcaccatcaagcacaaataattgggtcaaaactgcctttgaggtctgttgaagaaaatggttcattaagcaaaaaagagtagaggtattttatattagcagtaacagacaaattatttagtaatcccttaacctctgtttttcaaagagaaaatatccaatttagacttttttcctgatctctatatatagcatcaaattgggaaacaaaggccaaaggtgtatagattgcttgaaagggggtggtagtgcctctttttaagatctgttgagtcggctacagtctggctaagtaagaagcatttgcatactgattccatcatttaatctttaaaagtatgtgttttaaaaatgtaaccagaatgattcttcaatagaaatgagatttggtggagtctggattgcctgttttgtatataatatatacttaagatatataataccacctcattttctgggcattatttcctaattgttgatgtttcaggcttttgataagtcattttatatatttcaaatttaactcagaataagtaaatatttatggcaaatgcagttttatgtactttcaggagaagaccatcaggaaaagacaggacaaagaagtcaaacattaaagcccttgcaaatattagaggaccttagacaattaccaaaaagtgtttaatagggaagttgcaaatgattctcttagtaaattaaacatttaaaaagtagttttaatgtgccttgggcatcttgaaaagaagagtgtgatataatttatgcttagtgttaactggtcattttacattgtatttattaagtctgctgaaaaatgaggttttaaggaagaaaatgcagattattttagggtaaacaggccaggtgtcctttgaagaactttgtttacatcaaattgatgaaattacagtcagtgattccttactttttttgctagttgtactttgaaattgttatgggttcgatttccaaaatatgtaacttattttttaaaggaataaggtgtgctgtgtatttgttgattaaaaatcatttgtcttgcagagtatccttttttgaaggaaatatacatccttataacacatcaggtagttttcttttttctgtatttaaattatatatttgaattaattgaatataatttgagttacatataattctatataaaggttacatattgaattatggttctaatctgtttaggaaagaaatgaattttctaagcatttaatacatttggaataattttagtttctaaaaagtactaatgtaagttaagtttatatcaaatgcaaattaccttgtataactaacaagcacagttattgtttaacattatggattttaattgtgttgacacccttctttgaatttgttgctttacatgtgtgtctgtgtgtgtgtctgcatgtgtgcacgcatgtacttgtatgcaatgtaaaagtaacagcagaatcattgcatttggtttacttaaaattttggagttagcaagtaaacaaaaagctgatagttttatgaagtctcggttaaaataaaatttctttgctatctcactcctaggaagttatggagttcatattttcaaaagatatgttaaaaatggttacacactctgctggccacattaaaaattagaagactcatgttaaattatctcctccaaaggactttttatttacagcttttcttttcctggactctacctgcttggttcagtgtcctgaagagttatttaaatgaaccactacttagtaattagttcttttttaaagtatctacttctaaaattacctagttgaaaatatgaaggatatgcttagttttagaaatatcatgaagcaaggatctagtcagtgttacagggtaaaggtggagttttttaaagtctgtatttaaatggtgcactgatggattcatttttaatttgcattacaaaaatgttgctcaggtaatcagtattttcttccacgtatgtgcatattgcactgttagatcatagaaatatctgaatgctttaatttttatgtatgcaaaatctataaatcttttgtataatgtattttatacaaatgtaactgtagaacattgttagcatgtgtatctgtaaaaccagtttttaaaattttttgccccttatttttcatattttgaaagatctccaacatgtaataaagtttctcttattcaatctaaaatggaagccagtgaat

SEQ ID NO: 150283 - DNA, 1538 bp, Homo sapiens
  Payload ID: 9672
  Gene Symbol: LYSMD3
  Gene Name: LysM, putative peptidoglycan-binding, domain containing 3
  Uniprot ID: Q7Z3D4
  ENST ID: ENST00000509384
  CDS Start-End: 149-532
ggagacgttggcggcagaggcggaggcggacggggtcagcccaaagcagaggctcggccatgaacttacccgggacagcggcggcggcggaccttttggccatcttctcgcagagtgctccctgctaacggggacagattttaacattatggcagggaggcatcagaatcgtagttttcctcttccaggagttcagtcaagtggtcaagtacatgcatttggaaattgttcagacagtgatattttggaggaggatgctgaagtgtatgaacttcgatccagaggaaaagagaaagtccgaagaagtacatcaagagatagacttgacgacattatagtattaacaaaagatatacaagaaggagatacattaaatgcaatagcccttcagtactgttgtacggtctatcaaaattccagtaaaaaagttcagttccttgaccgaaacactttgtcctccaaaaggaagacagacttcacgtcattcatctgttcaatactcttccgaacaacaggaaattttgccagctaatgattctcttgcttacagtgactcagctggtagctttttaaaagaagtagaccgagacatagaacaaatagtaaagtgtacagacaataagagagagaacctcaatgaggtagtatcggccttaacagcacaacaaatgcgttttgaacctgataacaaaaacactcaacgtaaagacccctattatggagcagactggggaatagggtggtggacagctgtagtgataatgttgatagtaggtataataacaccagtgttttatttgttgtattatgaaattttagctaaggtggatgttagtcatcattcaacagtggactcttcacatttacattcaaaaatcacacccccatcacagcagagagaaatggaaaatggaattgtgccaactaaaggaatacatttcagccaacaagatgatcataaactgtatagtcaagattctcagtcacctgctgctcaacaggaaacatagcaattagctcataatcaaatgttagtggtcacatgtgcatctggaatgtggtgaatcagttatatccaataatagcttcaaaggcagaatttagagagattgaggatgcttttgtttttaacaaaagggtttcacactttgaaaattttttgagcaactagttgttgatgttgagagcagttgatccataaatctggtgtgtgaatgtttcaagcagaaattaatttaaatgtgtgtttaggaagtacttaacttggaagatgtatcatttttcttaaaatgcatgtttaaattttatttttttaagtaatttttaaaaagtttattaatgttaaatttatgatgcagaatgatagcatcagatgtctgcagctgaaaaaaatttactactatgaacccccaaaatattcagttgcaagaaaatttgattctaaaattattcatggtaggatacgtaacacaccccttcaaaacttttaaaaaatacatttagcacatgtgctatgaaagcatacgtacaaagagaaa

SEQ ID NO: 150284 - DNA, 2847 bp, Homo sapiens
  Payload ID: 9673
  Gene Symbol: LYSMD4
  Gene Name: LysM, putative peptidoglycan-binding, domain containing 4
  ENST ID: ENST00000332728
  CDS Start-End: 613-1125
gatgttcgtagccaatccgcaggcgcggtggcagctgcgggtcgcgggtcgcgggtcgcgagtcgccggtcgccggtcgcggcggagcctgggcgctgagaagggacttggagggaagcgggcctggagctgctgccgccgcccctgagctcggacgcgaaggctggccccgtccccgggctgccgccgtggtcctgcagtgaagaaaatgaggcacgaggaattgttaaccaagaccttccaaggcccagctgttgtgtgtgggactccgaccagccacgtatacatgtttaagaatggcagtggggactcgggggactcttctgaagaagagtctcaccgtgtggttttgcggccccggggcaaggagcgccacaagagcggtgtccaccagcctccccaggcgggagcaggtgacgtggtgctgctgcagcgggagctggcccaggaggacagcctcaacaagctggcgctgcagtatggctgcaaacattcagagtgattaacaatggcaaagttgcagatatcaagaaagtcaacaacttcatcagagaacaagacttatatgctttgaaatctgttaagattccagtgagaaaccatgggatcctgatggagacccacaaagaactgaaaccccttctgagcccgtcttccgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactaggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctggattctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcccggcctccaagagttctggacaggaggcagacactgcccagatgctcggtggagggacagtgatggcctttgactcatgaggcctggagaaaagtatcaaaggtctcaccatgtaagagtgatttccgatttctctcctttcagttgtgtgaaaaaacagctggcctgggttccattagcaaattaaatcatcttcaatcttaaattagaaaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggaggaaaattga

SEQ ID NO: 150285 - DNA, 2885 bp, Homo sapiens
  Payload ID: 9673
  Gene Symbol: LYSMD4
  Gene Name: LysM, putative peptidoglycan-binding, domain containing 4
  Uniprot ID: Q5XG99
  ENST ID: ENST00000344791
  CDS Start-End: 274-1167
cgcggtggcagctgcgggtcgcgggtcgcgggtcgcgagtcgccggtcgccggtcgcggcggagcctgggcgctgagaagggacttggagggaagcgggcctggagctgctgccgccgcccctgagctcggacgcgaaggctggccccgtccccgggctgccgccgtggtcctgcagtgaagaaaatgaggcacgaggaattgttaaccaagaccttccaaggcccagctgttgtgtgtgggactccgaccagccacgtatacatgtttaagaatggcagtggggactcgggggactcttctgaagaagagtctcaccgtgtggttttgcggccccggggcaaggagcgccacaagagcggtgtccaccagcctccccaggcgggagcaggtgacgtggtgctgctgcagcgggagctggcccaggaggacagcctcaacaagctggcgctgcagtatggctgcaaacacattttattttagacctaatggggctggagataccaggcagaatttaattccggatttctatgcattcagagtgattaacaatggcaaagttgcagatatcaagaaagtcaacaacttcatcagagaacaagacttatatgctttgaaatctgttaagattccagtgagaaaccatgggatcctgatggagacccacaaagaactgaaaccccttctgagcccgtcttccgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactaggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctggattctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcccggcctccaagagttctggacaggaggcagacactgcccagatgctcggtggagggacagtgatggcctttgactcatgaggcctggagaaaagtatcaaaggtctcaccatgtaagagtgatttccgatttctctcctttcagttgtgtgaaaaaacagctggcctgggttccattagcaaattaaatcatcttcaatcttaaattagaaaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggaggaaaa

SEQ ID NO: 150286 - DNA, 2122 bp, Homo sapiens
  Payload ID: 9673
  Gene Symbol: LYSMD4
  Gene Name: LysM, putative peptidoglycan-binding, domain containing 4
  ENST ID: ENST00000378904
  CDS Start-End: 1028-1423
agctgcgtttgctttggttagctagaaagcaggcccatcatgcatctgtaagaaagtgactggagtgtaggccctggcgtctaagccgagtaagatgccctgtcaatctgggtcctctgggaagcaagactgatgaaatgaggagcaccaaagctttacaccccagctatgtgcatttggggctggggctgcctgggaagagctcgtcctcagcccaaagcctgcaacagctgggatcagggcttacctctcacagacggggctcagcaactttctgcgggatgaggacacaagcccacttgacctggaacgtctgaaacctcctggccccgtggaagatgggaagaaacactcctcttcctctcagttttacaaccgagtggtcctcgggctgcttgtgagcaccggacgaccgaccgagcaggctgcagccaatcagctggcacagggctccgactgaaaatcatcttggctggtgccacagaatcggcctgaaaacaggatactgcctagagcaaggcacccaggggagccaagcaggaaaatgtaatgaattgactttaagtagctgcagctgtgattagagtatttttagccacaggactcaaccagctttcaaaacctgctaataagagccccaccgtagccagcgcaaaaatttagttttcagtttaacaccaggaatctgcttagctaggagctggcttagaaggcacatcaggagagaacatcttctactgaaagttgaagatttttcattttctagctgaattatgacaaagggagatgaccattaagtgcctgccagcatactgggacgtacacctaacactctgaaaactcaattcatgccagcacatctgtcttctgctgcatctagctcagcatcatgtatgtattttgggcaaaactaatcatttcacaccctagactttaaagagacccagaatctaatgatagctaacatacccaccccctctaacaggctttggcgtatttcctgtgagaagcagttactggaggccgaatggattccactcatccacagcactgtgcatgcaacagccagattaggccccggtgggactgcgtggcccactgcttcctatgggctccagggctgcccagcagggatgacccgggagccgacaagggggaggccagtgggggcgttgggacggtttccttgaccctgtctcaacccagagaaagaagcctgcaggtgaaaaaggtcttcgtgaaaggaatgaaaaaggagagggctttaggggaaggggctgcctggtggcaaagccagcgccttgtgtccccaggcaaacatgacagagtctcgacgcacaggaagagccagtccgtctttactggagtgagtgcgggagacaaacagtttacaacaacctttagcattgtcttcaccatttgataaaaagttcactattatatttattgtataatgaagaaaaacaacacattcagggaaaaattgagattaacttatttttcttaaaaggttcatctcaaggatggcaacaaagtccagcttgtgccgccaaacggttttacatgatcaaaccgtgtacagcttcttgtgtgaactgttgactacaaacatttaccaaatacataaatctcttttaaaaaagccattttaaatatagcaaagcagtgtcttcttgcacagcaaagtgaagaaagtttctacagagaaatagaagttttacatttgtaaaatctttttcacattctaatcatctagcttaagatccaatgccaggagttttcagcttccttatttactatgtatttcttgtgcgcatgatggttaatacagaaattatgttgatgcattactagttatccttctagttaaaggaaagggtaaaacatgtattgttcttgtagaacaaacccctgatttagtctataacaaaatggacataattgggctcaaaagatggagttttgattgggaccacctgtgtacacacaacagtgacttccactcgcggtggagtggccattagagtactgaggaaggacagctgttggaaactgtactttaaccagtgcaatttaagctttttttgcttttgttctttagtaataaaatacttctggaggg

SEQ ID NO: 150287 - DNA, 2672 bp, Homo sapiens
  Payload ID: 9673
  Gene Symbol: LYSMD4
  Gene Name: LysM, putative peptidoglycan-binding, domain containing 4
  Uniprot ID: Q5XG99
  ENST ID: ENST00000409796
  CDS Start-End: 64-954
ggggcctggacgagggggccgcggtctggctagggagccgcgcgggctcatggcgtgaagaaaatgaggcacgaggaattgttaaccaagaccttccaaggcccagctgttgtgtgtgggactccgaccagccacgtatacatgtttaagaatggcagtggggactcgggggactcttctgaagaagagtctcaccgtgtggttttgcggccccggggcaaggagcgccacaagagcggtgtccaccagcctccccaggcgggagcaggtgacgtggtgctgctgcagcgggagctggcccaggaggacagcctcaacaagctggcgctgcagtatggctgcaaagttgcagatatcaagaaagtcaacaacttcatcagagaacaagacttatatgctttgaaatctgttaagattccagtgagaaaccatgggatcctgatggagacccacaaagaactgaaaccccttctgagcccgtcttccgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactaggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctggattctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcccggcctccaagagttctggacaggaggcagacactgcccagatgctcggtggagggacagtgatggcctttgactcatgaggcctggagaaaagtatcaaaggtctcaccatgtaagagtgatttccgatttctctcctttcagttgtgtgaaaaaacagctggcctgggttccattagcaaattaaatcatcttcaatcttaaattagaaaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggaggaaaa

SEQ ID NO: 150288 - DNA, 559 bp, Homo sapiens
  Payload ID: 9673
  Gene Symbol: LYSMD4
  Gene Name: LysM, putative peptidoglycan-binding, domain containing 4
  ENST ID: ENST00000450512
  CDS Start-End: 190-559
gtagccaatccgcaggcgcggtggcagctgcgggtcgcgggtcgcgggtcgcgagtcgccggtcgccggtcgcggcggagcctgggcgctgagtgaagaaaatgaggcacgaggaattgttaaccaagaccttccaaggcccagctgttgtgtgtgggactccgaccagccacgtatacatgtttaagaatggcagtggggactcgggggactcttctgaagaagagtctcaccgtgtggttttgcggccccggggcaaggagcgccacaagagcggtgtccaccagcctccccaggcgggagcaggtgacgtggtgctgctgcagcgggagctggcccaggaggacagcctcaacaagctggcgctgcagtatggctgcaaaacctaatggggctggagataccaggcagaatttaattccggatttctatgcattcagagtgattaacaatggcaaagttgcagatatcaagaaagtcaacaacttcatcagagaacaagacttatatgctttgaaatctgttaagattccagtgagaaaccatgggatcctgatgg

SEQ ID NO: 150289 - DNA, 2431 bp, Homo sapiens
  Payload ID: 9673
  Gene Symbol: LYSMD4
  Gene Name: LysM, putative peptidoglycan-binding, domain containing 4
  ENST ID: ENST00000545021
  CDS Start-End: 2-709
gatgttcgtagccaatccgcaggcgcggtggcagctgcgggtcgcgggtcgcgggtcgcgagtcgccggtcgccggtcgcggcggagcctgggcgctgaggttgcagatatcaagaaagtcaacaacttcatcagagaacaagacttatatgctttgaaatctgttaagattccagtgagaaaccatgggatcctgatggagacccacaaagaactgaaaccccttctgagcccgtcttccgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactaggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctggattctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcccggcctccaagagttctggacaggaggcagacactgcccagatgctcggtggagggacagtgatggcctttgactcatgaggcctggagaaaagtatcaaaggtctcaccatgtaagagtgatttccgatttctctcctttcagttgtgtgaaaaaacagctggcctgggttccattagcaaattaaatcatcttcaatcttaaattagaaaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggaggaaaattga

SEQ ID NO: 150290 - DNA, 5060 bp, Homo sapiens
  Payload ID: 9674
  Gene Symbol: LCLAT1
  Gene Name: lysocardiolipin acyltransferase 1
  Uniprot ID: Q6UWP7
  ENST ID: ENST00000309052
  CDS Start-End: 210-1454
ggccggacgcctccgcgttacgggatgaattaacggcgggttccgcacggaggttgtgacccctacggagccccagcttgcccacgcaccccactcggcgtcgcgcggcgtgccctgcttgtcacaggtgggaggctggaactatcaggctgaaaaacagagtgggtactctcttctgggaagctggcaacaaatggatgatgtgatatatgcattccaggggaagggaaattgtggtgcttctgaacccatggtcaattaacgaggcagtttctagctactgcacgtacttcataaagcaggactctaaaagctttggaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggttgggccatgcaggctgctgcctatatcttcattcataggaaatggaaggatgacaagagccatttcgaagacatgattgattacttttgtgatattcacgaaccacttcaactcctcatattcccagaagggactgatctcacagaaaacagcaagtctcgaagtaatgcatttgctgaaaaaaatggacttcagaaatatgaatatgttttacatccaagaactacaggctttacttttgtggtagaccgtctaagagaaggtaagaaccttgatgctgtccatgatatcactgtggcgtatcctcacaacattcctcaatcagagaagcacctcctccaaggagactttcccagggaaatccactttcacgtccaccggtatccaatagacaccctccccacatccaaggaggaccttcaactctggtgccacaaacggtgggaagagaaagaagagaggctgcgttccttctatcaaggggagaagaatttttattttaccggacagagtgtcattccaccttgcaagtctgaactcagggtccttgtggtcaaattgctctctatactgtattggaccctgttcagccctgcaatgtgcctactcatatatttgtacagtcttgttaagtggtattttataatcaccattgtaatctttgtgctgcaagagagaatatttggtggactggagatcatagaacttgcatgttaccgacttttacacaaacagccacatttaaattcaaagaaaaatgagtaagattataaggtttgccatgtgaaaacctagagcatattttggaaatgttctaaacctttctaagctcagatgcatttttgcatgactatgtcgaatatttcttactgccatcattatttgttaaagatattttgcacttaattttgtgggaaaaatattgctacaattttttttaatctctgaatgtaatttcgatactgtgtacatagcagggagtgatcggggtgaaataacttgggccagaatattattaaacaatcatcaggcttttagcgacaaggaacacacacatttttcttaaaggcccaatcctaacagactccccgtaccagaggcagatctggaactcgtcaacaacagcccggatcacatgctgttactggactgcccaggtcacctcattgaggtgagcgctgtccctccaggtactcaggcaggtggtgcccaggctccctcccttggcgtccttcttcctgcgccaaacccatctcatccttaagatcagaaaatggaaccccctttgtcgtgaaaccgatcaagcattttgacaggaagcccttcattattcataacattgtatgctgaccaagacgtcagaagaccacctgtgcccttttctctcgtggaagataaaacctggactcagggagcaaccacaggctctccactttgaaactttagtttgaattttaaaagataggaagtaatacagtttaagttcctttctcacactcagtattgcatgcttagtgctggttttcttacaacattttggcaggtgtagctttttctgttaaaaatggtatacatgaagtcacatacttttttaaaggaacactcagaacattctgtcattccagtcagaaactgtcttttgaaatatttctttacaacctaccaaaaaaggaaggttgttttttctacatgtgcttgggtatctaacatctaccattaaaacaacaaatggcttgcagacagggcagtaatggtttatcctaaattactcaaccccttgtagccttgacaaattttaccttaaaaccaaaatgaaacacaaaaattaatccttaataatgatagcaagtgatctttctttttagttttagccttcctttttcaatagtaatatttaaacccacttttgaccaattgtttgcccaaatattcttgtcatttggagtcagtggaaaatccagcacaccaagcaccagtcttcttctgaggcaaaagaaaagtgttgtcattttcactctgttggagctgcacacttttttttctttttttttttctttttttttttgtcgtgtaagaaggatgctggtcagagctgcagaaaatatgaggcaattaaaagtctttagctgttagcaaacctgttagttttacttctgcattgaaccagcctcagaagctacttactgctttatgtactctttgggcattaatgccttctctgtaattatatctcgtttttgcttgacagtgacctacccaataattgcatcgtgcattgccatgaaaggtaaacacattgtgaactgaacttaccaagcagattctgtgagaaagcactggttgaggctgaacactgttgacacatcatttttattggaagagtattaactggtgcctcttctgaaacacaccaacccatattcctctgctcccccaaagctgtttctgatcctgctgggagcaactaactagttattatgcacatctgctccagacccagctctttaacttcatggttttacagcttgttttttctttttcttttctttttttttttttttttttaaaaaagcacctttttttgttgtttccccttaataaaagaggtttctaatttatgtttctctaagatttcctttggttgtatttagaaacacaaatagttttataatcaggattgcatttgtgctgggtaaaagaggagagctgtgctttctaccccaaagttgttggtaatggagccggtctgcccttcctacaaactcaagaggctcattgttcaaggtgtaacaacatttaattgcatgtcctctaacgctttgaaacctttagagggaagatcctcattttttacaattttgttccttttcatcatagaaaacatgtttaagataaaatacaaactttacctaccccaaattcataaagtacatttagtgctgtatagcactaaaacttagagatacagacactgtacttactttttaagaattagagacagtaactccaaaaataattgtccttttttctttctttctttttttacaataaggctcttgaaaattgtcattacttgtgttttcctatacattcatctgtgtgaaagcctttttcttctttgatttaaaaaaattaactatacagttaatggtttagaacttagaactacttagaattaatgctaaagtgtcaggaagaaattaatttagcttcaataattgtgactggcctcaggaattctcccttccacacctgcccacctcacctcactgcaccgcaccgcaccagagccagagcagctgcttgtctgcagcaggacacagttcctacatacgtttcagttctttcatggtaagctcaatggactttgaattgtttacagtgctgtatgtccaattgttaaatgtaccattctgaacgatgttaaagcaagtgtggtttatttatggcatgaaccatgtaacttgaaatatgaacttacaaggaggggcactcattaggtaacaagttcttacaccaaacttccttgatgaaataagccaaaataatcctaaaattcattagaagaacttgataaaagactcaaataaatgttagaaagagcccgtaattttaggactcctataaaattcttccttgtttgttaatgctattaaaactcagattcaagggaaataccagcttccacttgagtcactttgaaatagttaattcaacagcaccatgttagaaatatattggcagccaagactctgaactctgcagaaacatttgtttcacccagacttcaaactctagccctgactatgatgcccctgtgtgcatttacaataaagactccaacggagggagcctgttggtgttaaattgtttacatttctttatacaaataatgtgctttcagtgccttagttacagctccctttctgtttcttgttccaaggattctgtagtatgtagtgtgtttcttaggtaaagtctctttttgctactgaaagggaaatggtctctaaacactggtcactgtagcaggtaaacactactctaacgtggagaaatgagcttcatgctgaggtagtggttgccttagagctgttatttatgctgtagaaaacgaaaatggttttgctacctgataagcttcagattagatatagccctaaagttatcctgtacctgcattaaattttcattttagaagagaatcttggttttggtaattcatttttttttaagatcattatgtgcaaaacaccaagttttaaaaataactcacagaatggccttagttttcaatgtctgatggtatatttgtgagttgtgttatctgtaatatacatcccagaataaaggagtgaattaaatagttta

SEQ ID NO: 150291 - DNA, 4888 bp, Homo sapiens
  Payload ID: 9674
  Gene Symbol: LCLAT1
  Gene Name: lysocardiolipin acyltransferase 1
  Uniprot ID: Q6UWP7
  ENST ID: ENST00000379509
  CDS Start-End: 153-1283
gggacgcattactagggcgacggccggacgcctccgcgttacgggatgaattaacggcgggttccgcacggaggttgtgacccctacggagccccagcttgcccacgcaccccactcggcgtcgcgcggcgtgccctgcttgtcacagaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggttgggccatgcaggctgctgcctatatcttcattcataggaaatggaaggatgacaagagccatttcgaagacatgattgattacttttgtgatattcacgaaccacttcaactcctcatattcccagaagggactgatctcacagaaaacagcaagtctcgaagtaatgcatttgctgaaaaaaatggacttcagaaatatgaatatgttttacatccaagaactacaggctttacttttgtggtagaccgtctaagagaaggtaagaaccttgatgctgtccatgatatcactgtggcgtatcctcacaacattcctcaatcagagaagcacctcctccaaggagactttcccagggaaatccactttcacgtccaccggtatccaatagacaccctccccacatccaaggaggaccttcaactctggtgccacaaacggtgggaagagaaagaagagaggctgcgttccttctatcaaggggagaagaatttttattttaccggacagagtgtcattccaccttgcaagtctgaactcagggtccttgtggtcaaattgctctctatactgtattggaccctgttcagccctgcaatgtgcctactcatatatttgtacagtcttgttaagtggtattttataatcaccattgtaatctttgtgctgcaagagagaatatttggtggactggagatcatagaacttgcatgttaccgacttttacacaaacagccacatttaaattcaaagaaaaatgagtaagattataaggtttgccatgtgaaaacctagagcatattttggaaatgttctaaacctttctaagctcagatgcatttttgcatgactatgtcgaatatttcttactgccatcattatttgttaaagatattttgcacttaattttgtgggaaaaatattgctacaattttttttaatctctgaatgtaatttcgatactgtgtacatagcagggagtgatcggggtgaaataacttgggccagaatattattaaacaatcatcaggcttttagcgacaaggaacacacacatttttcttaaaggcccaatcctaacagactccccgtaccagaggcagatctggaactcgtcaacaacagcccggatcacatgctgttactggactgcccaggtcacctcattgaggtgagcgctgtccctccaggtactcaggcaggtggtgcccaggctccctcccttggcgtccttcttcctgcgccaaacccatctcatccttaagatcagaaaatggaaccccctttgtcgtgaaaccgatcaagcattttgacaggaagcccttcattattcataacattgtatgctgaccaagacgtcagaagaccacctgtgcccttttctctcgtggaagataaaacctggactcagggagcaaccacaggctctccactttgaaactttagtttgaattttaaaagataggaagtaatacagtttaagttcctttctcacactcagtattgcatgcttagtgctggttttcttacaacattttggcaggtgtagctttttctgttaaaaatggtatacatgaagtcacatacttttttaaaggaacactcagaacattctgtcattccagtcagaaactgtcttttgaaatatttctttacaacctaccaaaaaaggaaggttgttttttctacatgtgcttgggtatctaacatctaccattaaaacaacaaatggcttgcagacagggcagtaatggtttatcctaaattactcaaccccttgtagccttgacaaattttaccttaaaaccaaaatgaaacacaaaaattaatccttaataatgatagcaagtgatctttctttttagttttagccttcctttttcaatagtaatatttaaacccacttttgaccaattgtttgcccaaatattcttgtcatttggagtcagtggaaaatccagcacaccaagcaccagtcttcttctgaggcaaaagaaaagtgttgtcattttcactctgttggagctgcacacttttttttctttttttttttctttttttttttgtcgtgtaagaaggatgctggtcagagctgcagaaaatatgaggcaattaaaagtctttagctgttagcaaacctgttagttttacttctgcattgaaccagcctcagaagctacttactgctttatgtactctttgggcattaatgccttctctgtaattatatctcgtttttgcttgacagtgacctacccaataattgcatcgtgcattgccatgaaaggtaaacacattgtgaactgaacttaccaagcagattctgtgagaaagcactggttgaggctgaacactgttgacacatcatttttattggaagagtattaactggtgcctcttctgaaacacaccaacccatattcctctgctcccccaaagctgtttctgatcctgctgggagcaactaactagttattatgcacatctgctccagacccagctctttaacttcatggttttacagcttgttttttctttttcttttctttttttttttttttttttaaaaaagcacctttttttgttgtttccccttaataaaagaggtttctaatttatgtttctctaagatttcctttggttgtatttagaaacacaaatagttttataatcaggattgcatttgtgctgggtaaaagaggagagctgtgctttctaccccaaagttgttggtaatggagccggtctgcccttcctacaaactcaagaggctcattgttcaaggtgtaacaacatttaattgcatgtcctctaacgctttgaaacctttagagggaagatcctcattttttacaattttgttccttttcatcatagaaaacatgtttaagataaaatacaaactttacctaccccaaattcataaagtacatttagtgctgtatagcactaaaacttagagatacagacactgtacttactttttaagaattagagacagtaactccaaaaataattgtccttttttctttctttctttttttacaataaggctcttgaaaattgtcattacttgtgttttcctatacattcatctgtgtgaaagcctttttcttctttgatttaaaaaaattaactatacagttaatggtttagaacttagaactacttagaattaatgctaaagtgtcaggaagaaattaatttagcttcaataattgtgactggcctcaggaattctcccttccacacctgcccacctcacctcactgcaccgcaccgcaccagagccagagcagctgcttgtctgcagcaggacacagttcctacatacgtttcagttctttcatggtaagctcaatggactttgaattgtttacagtgctgtatgtccaattgttaaatgtaccattctgaacgatgttaaagcaagtgtggtttatttatggcatgaaccatgtaacttgaaatatgaacttacaaggaggggcactcattaggtaacaagttcttacaccaaacttccttgatgaaataagccaaaataatcctaaaattcattagaagaacttgataaaagactcaaataaatgttagaaagagcccgtaattttaggactcctataaaattcttccttgtttgttaatgctattaaaactcagattcaagggaaataccagcttccacttgagtcactttgaaatagttaattcaacagcaccatgttagaaatatattggcagccaagactctgaactctgcagaaacatttgtttcacccagacttcaaactctagccctgactatgatgcccctgtgtgcatttacaataaagactccaacggagggagcctgttggtgttaaattgtttacatttctttatacaaataatgtgctttcagtgccttagttacagctccctttctgtttcttgttccaaggattctgtagtatgtagtgtgtttcttaggtaaagtctctttttgctactgaaagggaaatggtctctaaacactggtcactgtagcaggtaaacactactctaacgtggagaaatgagcttcatgctgaggtagtggttgccttagagctgttatttatgctgtagaaaacgaaaatggttttgctacctgataagcttcagattagatatagccctaaagttatcctgtacctgcattaaattttcattttagaagagaatcttggttttggtaattcatttttttttaagatcattatgtgcaaaacaccaagttttaaaaataactcacagaatggccttagttttcaatgtctgatggtatatttgtgagttgtgttatctgtaatatacatcccagaataaaggagtgaattaaatagttt

SEQ ID NO: 150292 - DNA, 2774 bp, Homo sapiens
  Payload ID: 9674
  Gene Symbol: LCLAT1
  Gene Name: lysocardiolipin acyltransferase 1
  Uniprot ID: Q6UWP7
  ENST ID: ENST00000319406
  CDS Start-End: 203-1129
attactagggcgacggccggacgcctccgcgttacgggatgaattaacggcgggttccgcacggaggttgtgacccctacggagccccagcttgcccacgcaccccactcggcgtcgcgcggcgtgccctgcttgtcacaggctgaaaaacagagtgggtactctcttctgggaagctggcaacaaatggatgatgtgatatatgcattccaggggaagggaaattgtggtgcttctgaacccatggtcaattaacgaggcagtttctagctactgcacgtacttcataaagcaggactctaaaagctttggaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggttgggccatgcaggctgctgcctatatcttcattcataggaaatggaaggatgacaagagccatttcgaagacatgattgattacttttgtgatattcacgaaccacttcaactcctcatattcccagaagggactgatctcacagaaaacagcaagtctcgaagtaatgcatttgctgaaaaaaatggacttcagaaatatgaatatgttttacatccaagaactacaggctttacttttgtggtagaccgtctaagagaaggcaggaggcagagcgagggaagtaaaggaccacttcaaggagaactacaaatcactgctcaaggaaatcagagaggacacaaacaaatggaaaaacactccatgctcatggattggaagaatcaatatcgtgaaattggccatactgcccaaagcaatttacagattcaatgctattcccattaaactgccgttgacattcttcatagaattagaaaaaactcttaaaattcatatggaaccaacaaaaagcccatatagccaagacaatcttaagcaaaaagaacacagctggaggcatcacattacctgacttcaaactatactacagggctacagtaaccaaaatagcatggtactgttacaaaaacagacacatagaccaatggaacagaatagagaactcagaaataagtccgtgcaactacagccatctgatctttgacaaacctgacaaaaacaagcaatggggaaaggattccctatttaataaatggtgctgggagaactggctagccatatgcagaaaactgaaactggaccccttccttacaccttatgcaaaaattaactcaagatggattaaagacttaaatgaaaaacccaaaactataaaaaccctagaaaaaaatctaggcaataccattcaggacataagcatgggcaaagatttcatgatgaagatgacaaaagcaattgcaaccaaagcaaaaattgacaaatgggatctgattaaactaaagggcttctgcacaggaaaagaaactatcatcagagcaaacagacattctacagaaagggagaaaatttttgcaatctatccatctgacaaaggtctaatattcagagtcaacaagaaactaaaacaaatttacaagaaaaaacaaccccattaaaaaagtgggcaagggacatgaacagacacttctcaaaagaagacatttatatggctaataaacttatgaaaaaaagctcaacatcactgatcatcagagaaatgcaaatcaaaaccacaatgagataccatctcacaccagtccaaatggcaattatttaaaagtcatgaaacaacagatgctggcaaggctgtggagcgagaggaatgcttttacattgttggtgggaatgtatattagttcaaccattgtgtagctgggactacaggcgtccactaccacgcccggctaatttttttgtatttttagtagagacagggtttcaccatgttagccaggatggtctcgatctcctgacctcatgatccacccgcctcagcttcccaaagtgctgggattacaggcatgagccaccgcgcccagccaaggaaatatctttatagatgtcttcttgtgtacctgtgtaagaattcctttgggatatacagtcatgcaacacataatgacgttctagttagtggcaaaccacatatatgatggcagtctcataagatcataatggagctagaaaattcctatcacctggtgacatcatcacatgtttgtgatgatgctgatgtaaaccactatgctaccagttgtgtaaaacagtagcacataaaattatataccgtaatgataatgactatgttactgatttacatagttactgtactatactttttattgttacttgagtgtattccttctgcttatagtaaaagcagtaaaacagccccaggcaggtccttcaggaggtattccagaagaaggcattgctgtcataggacatgacagctccatgcttgttattacctctgaagaccttgcagtgagacaagatgtggaggtgaagacagtgatattgatgatcctgaccctgtgtaggcctaggc

SEQ ID NO: 150293 - DNA, 560 bp, Homo sapiens
  Payload ID: 9674
  Gene Symbol: LCLAT1
  Gene Name: lysocardiolipin acyltransferase 1
  ENST ID: ENST00000465538
  CDS Start-End: 192-560
cggccggacgcctccgcgttacgggatgaattaacggcgggttccgcacggaggttgtgacccctacggagccccagcttgcccacgcaccccactcggcgtcgcgcggcgtgccctgcttgtcacagataggaccatctagtctcaggaaaacaagctcagaacgctcgccgattctaccattatgaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggtagg

SEQ ID NO: 150294 - DNA, 658 bp, Homo sapiens
  Payload ID: 9674
  Gene Symbol: LCLAT1
  Gene Name: lysocardiolipin acyltransferase 1
  ENST ID: ENST00000497423
  CDS Start-End: 198-658
gaggctggaactatcaggtggggttacggcgcgaggaaaatggcggcggccgggggatctcagaggtgcaggaaggggagctgcagcccgggcttttcctcctgagccatggaccttccccgggccgcgacctcgggctgaaaaacagagtgggtactctcttctgggaagctggcaacaaatggatgatgtgatatatgcattccaggggaagggaaattgtggtgcttctgaacccatggtcaattaacgaggcagtttctagctactgcacgtacttcataaagcaggactctaaaagctttggaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaa

SEQ ID NO: 150295 - DNA, 536 bp, Homo sapiens
  Payload ID: 9674
  Gene Symbol: LCLAT1
  Gene Name: lysocardiolipin acyltransferase 1
  ENST ID: ENST00000488144
  CDS Start-End: 221-536
agggcgacggccggacgcctccgcgttacgggatgaattaacggcgggttccgcacggaggttgtgacccctacggagccccagcttgcccacgcaccccactcggcgtcgcgcggcgtgccctgcttgtcacagatgtagttctgatagcagcattcccctctccaccattgtaccatacaagtgagtgggcttggagaatacagttctcaagataatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagat

SEQ ID NO: 150296 - DNA, 537 bp, Homo sapiens
  Payload ID: 9674
  Gene Symbol: LCLAT1
  Gene Name: lysocardiolipin acyltransferase 1
  ENST ID: ENST00000476535
  CDS Start-End: 126-537
aggtggggttacggcgcgaggaaaatggcggcggccgggggatctcagaggtgcaggaaggggagctgcagcccgggcttttcctcctgagccatggaccttccccgggccgcgacctcggaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggttgggccatgcaggctgctgcctatatcttcattcataggaaatgga

SEQ ID NO: 150297 - DNA, 584 bp, Homo sapiens
  Payload ID: 9674
  Gene Symbol: LCLAT1
  Gene Name: lysocardiolipin acyltransferase 1
  ENST ID: ENST00000476038
  CDS Start-End: 113-584
acgggatgaattaacggcgggttccgcacggaggttgtgacccctacggagccccagcttgcccacgcaccccactcggcgtcgcgcggcgtgccctgcttgtcacagaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttgaaaacagcaagtctcgaagtaatgcatttgctgaaaaaaatggacttcagaaatatgaatatgttttacatccaagaactacaggctttacttttgtggtagaccgtc

SEQ ID NO: 150298 - DNA, 1862 bp, Homo sapiens
  Payload ID: 9674
  Gene Symbol: LCLAT1
  Gene Name: lysocardiolipin acyltransferase 1
  ENST ID: ENST00000478015
  CDS Start-End: 173-373
gttacgggatgaattaacggcgggttccgcacggaggttgtgacccctacggagccccagcttgcccacgcaccccactcggcgtcgcgcggcgtgccctgcttgtcacaggctgaaaaacagagtgggtactctcttctgggaagctggcaacaaatggatgatgtgatatatgcattccaggggaagggaaattgtggtgcttctgaacccatggtcaattaacgaggcagtttctagctactgcacgtacttcataaagcaggactctaaaagctttggccactccacatcacttgaattatctcctgatttccacctctgctcagatccgccactgcattcgattcttacaggaacgcaggccctataactgtgcttgcaggggatctaggttgcatgttccttaggagaatctaatgcctgatgatctgtcactgtctcctatcatccccagataggaccatctagtctcaggaaaacaagctcagaacgctcgccgattctaccattatgaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggttgggccatgcaggctgctgcctatatcttcattcataggaaatggaaggatgacaagagccatttcgaagacatgattgattacttttgtgatattcacgaaccacttcaactcctcatattcccagaagggactgatctcacagaaaacagcaagtctcgaagtaatgcatttgctgaaaaaaatggacttcagaaatatgaatatgttttacatccaagaactacaggctttacttttgtggtagaccgtctaagagaaggtaagaaccttgatgctgtccatgatatcactgtggcgtatcctcacaacattcctcaatcagagaagcacctcctccaaggagactttcccagggaaatccactttcacgtccaccggtatccaatagacaccctccccacatccaaggaggaccttcaactctggtgccacaaacggtgggaagagaaagaagagaggctgcgttccttctatcaaggggagaagaatttttattttaccggacagagtgtcattccaccttgcaagtctgaactcagggtccttgtggtcaaattgctctctatactgtattggaccctgttcagccctgcaatgtgcctactcatatatttgtacagtcttgttaagtggtattttataatcaccattgtaatctttgtgctgcaagagagaatatttggtggactggagatcatagaacttgcatgttaccgacttttacacaaacagccacatttaaattcaaagaaaaatgagtaagattataaggtttgccatgtgaaaacctagagcatattttggaaatgttctaaacctttctaagctcagatgcatttttgcatgactatgtcgaatatttcttactgccatcattatttgttaaagatattttgcacttaattttgtgggaaaaatattgctacaattttttttaatctctgaatgtaatttcgatactgtgtacatagca

SEQ ID NO: 150299 - DNA, 583 bp, Homo sapiens
  Payload ID: 9674
  Gene Symbol: LCLAT1
  Gene Name: lysocardiolipin acyltransferase 1
  ENST ID: ENST00000466477
  CDS Start-End: 163-583
gtagccttccgggacgcattactagggcgacggccggacgcctccgcgttacgggatgaattaacggcgggttccgcacggaggttgtgacccctacggagccccagcttgcccacgcaccccactcggcgtcgcgcggcgtgccctgcttgtcacagaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttgcacagtcacatttgaaacctaatgatacaggcatactacaacaggattgttgctgca

SEQ ID NO: 150300 - DNA, 582 bp, Homo sapiens
  Payload ID: 9674
  Gene Symbol: LCLAT1
  Gene Name: lysocardiolipin acyltransferase 1
  ENST ID: ENST00000465200
  CDS Start-End: 174-582
gggacgcattactagggcgacggccggacgcctccgcgttacgggatgaattaacggcgggttccgcacggaggttgtgacccctacggagccccagcttgcccacgcaccccactcggcgtcgcgcggcgtgccctgcttgtcacaggtgggaggctggaactatcagaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggttgggccatgcaggctgctgcctatatcttcattcataggaaat

SEQ ID NO: 150301 - DNA, 2687 bp, Homo sapiens
  Payload ID: 9675
  Gene Symbol: LPAR1
  Gene Name: lysophosphatidic acid receptor 1
  Uniprot ID: Q92633
  ENST ID: ENST00000358883
  CDS Start-End: 349-1443
acggcgcgctgggctcacactgtcccgccgcggacgggctttgtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgt

SEQ ID NO: 150302 - DNA, 2993 bp, Homo sapiens
  Payload ID: 9675
  Gene Symbol: LPAR1
  Gene Name: lysophosphatidic acid receptor 1
  Uniprot ID: Q92633
  ENST ID: ENST00000374430
  CDS Start-End: 256-1350
agaaagcagggctgcatggtgtggggatgctgctgctactcattcctgctcattccagtgttctggaaaatgaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcata

SEQ ID NO: 150303 - DNA, 3637 bp, Homo sapiens
  Payload ID: 9675
  Gene Symbol: LPAR1
  Gene Name: lysophosphatidic acid receptor 1
  Uniprot ID: Q92633
  ENST ID: ENST00000374431
  CDS Start-End: 385-1479
gtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacgtactttatacaaaatacagaatactttatattggaagtgaaagaaatgaacgtggacttttacacatgtgcatatttttctggaggctatatggattatttgaaatgaaaagcatactaattggactttaataaatcattttcaatca

SEQ ID NO: 150304 - DNA, 1019 bp, Homo sapiens
  Payload ID: 9675
  Gene Symbol: LPAR1
  Gene Name: lysophosphatidic acid receptor 1
  ENST ID: ENST00000441240
  CDS Start-End: 474-1019
ctggcggctgacgctccctgagtggcgactccgtctccagccccgctgcggagcgcgggccggatctggggcggccagggcccggagccgcggagccctccccgccgcccggccgagcacgggaccccggcggggtgggcgcagggggcggccccgctctgggcgactgccgaggggcgggcggagggccgggctcggctggcggtggggcgggggccgccgggactgggcgcgcggcctgaagccagcccgggggcggcaggagagggacgcgcggcggcagcgagcgcaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctataccc

SEQ ID NO: 150305 - DNA, 2490 bp, Homo sapiens
  Payload ID: 9675
  Gene Symbol: LPAR1
  Gene Name: lysophosphatidic acid receptor 1
  ENST ID: ENST00000541779
  CDS Start-End: 350-1390
ctcaagggaacagctcctgcccaggtctgtgggcactcagcatggatttcagtctccctgtgagtgatgggaaagaactaacagaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagtgggaggtgatttcttctttggcgagagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcatt

SEQ ID NO: 150306 - DNA, 1791 bp, Homo sapiens
  Payload ID: 9676
  Gene Symbol: LPAR2
  Gene Name: lysophosphatidic acid receptor 2
  Uniprot ID: Q9HBW0
  ENST ID: ENST00000407877
  CDS Start-End: 149-1204
agaccccgcctcccgcgccctctcagcaacccgcacagggcgcacccggacgctctaccgctcccgccgcagtcgccgggccatgggcctcgagcccgccccgaacccccgcgagcccgccttgtctgcggcgtgactggaggcccagatggtcatcatgggccagtgctactacaacgagaccatcggcttcttctataacaacagtggcaaagagctcagctcccactggcggcccaaggatgtggtcgtggtggcactggggctgaccgtcagcgtgctggtgctgctgaccaatctgctggtcatagcagccatcgcctccaaccgccgcttccaccagcccatctactacctgctcggcaatctggccgcggctgacctcttcgcgggcgtggcctacctcttcctcatgttccacactggtccccgcacagcccgactttcacttgagggctggttcctgcggcagggcttgctggacacaagcctcactgcgtcggtggccacactgctggccatcgccgtggagcggcaccgcagtgtgatggccgtgcagctgcacagccgcctgccccgtggccgcgtggtcatgctcattgtgggcgtgtgggtggctgccctgggcctggggctgctgcctgcccactcctggcactgcctctgtgccctggaccgctgctcacgcatggcacccctgctcagccgctcctatttggccgtctgggctctgtcgagcctgcttgtcttcctgctcatggtggctgtgtacacccgcattttcttctacgtgcggcggcgagtgcagcgcatggcagagcatgtcagctgccacccccgctaccgagagaccacgctcagcctggtcaagactgttgtcatcatcctgggggcgttcgtggtctgctggacaccaggccaggtggtactgctcctggatggtttaggctgtgagtcctgcaatgtcctggctgtagaaaagtacttcctactgttggccgaggccaactccctggtcaatgctgctgtgtactcttgccgagatgctgagatgcgccgcaccttccgccgccttctctgctgcgcgtgcctccgccagtccacccgcgagtctgtccactatacatcctctgcccagggaggtgccagcactcgcatcatgcttcccgagaacggccacccactgatggactccaccctttagctaccttgaacttcagcggtacgcggcaagcaacaaatccacagcccctgatgacttgtgggtgctcctggctcaacccaaccaacaggactgactgactggcaggacaaggtctggcatggcacagcaccactgccaggcctccccaggcacaccactctgcccagggaatgggggctttgggtcatctcccactgcctgggggagtcagatggggtgcaggaatctggctcttcagccatctcaggtttagggggtttgtaacagacattattctgttttcactgcgtatccttggtaagccctgtggactggttcctgctgtgtgatgctgagggttttaaggtggggagagataagggctctctcgggccatgctacccggtatgactgggtaatgaggacagactgtggacaccccatctacctgagtctgattctttagcagcagagactgaggggtgcagagtgtgagctgggaaaggtttgtggctccttgcagcctccagggactggcctgtccccgatagaattgaagcagtccacggggaggggatgatacaaggagtaaacctttctttacactc

SEQ ID NO: 150307 - DNA, 2546 bp, Homo sapiens
  Payload ID: 9676
  Gene Symbol: LPAR2
  Gene Name: lysophosphatidic acid receptor 2
  Uniprot ID: Q9HBW0
  ENST ID: ENST00000542587
  CDS Start-End: 904-1959
ataacaaagtaccgataaccgggacaatggggctgtgtgctccggaccgtgggagcccggggccgccgcagggaggccgagggaggaagccacagggcagggcagggcagggccgggctttgcagggggcagcgctgtcccagggtgaggggtacgggggcgggattgcaaaaccctagcgtgcgcccgatgatcagctggggccgcagaggtgggcctcgcacaggaggccgcggctcgctgatactgcgagctggcaaagccgaagctgggcgggggtccgggcggtgggagccaagtcggatcagggagtggcttgtaactcggcggccgattggacacgaagaagagagcggggtggggctgggagggttgggggtccggagcgggggcgcggacccaagaccacctggagctccgcccgggcagcgcggggtcacggcgggaattttcgggtcgccgagtgactcagccccgcaggctcgaaactgcgggcgcatgagtcgccgggccatgggcctcgagcccgccccgaacccccgcgagcccgccttgtctgcggcgtgactggaggcccagtctggagacgcctggaggcccggccatccatcccttccccaaccgctgtctttgtcccggagaccgccagtgtcctccgtcccacccggaacagcctattgccccgcccgcttgggaagcactcgcgcccaaatcccgccgactaacttctggggccgcctctctgtccactccgatcacctccacgcctcggcaccgccccctcgcagggttctagtcttattagtaggtaagaaacagctgctcctccacctccaccccagccccatggagcttgctttttccaggccaccgtagtcctcaccactgccactttgcttcgagatggtcatcatgggccagtgctactacaacgagaccatcggcttcttctataacaacagtggcaaagagctcagctcccactggcggcccaaggatgtggtcgtggtggcactggggctgaccgtcagcgtgctggtgctgctgaccaatctgctggtcatagcagccatcgcctccaaccgccgcttccaccagcccatctactacctgctcggcaatctggccgcggctgacctcttcgcgggcgtggcctacctcttcctcatgttccacactggtccccgcacagcccgactttcacttgagggctggttcctgcggcagggcttgctggacacaagcctcactgcgtcggtggccacactgctggccatcgccgtggagcggcaccgcagtgtgatggccgtgcagctgcacagccgcctgccccgtggccgcgtggtcatgctcattgtgggcgtgtgggtggctgccctgggcctggggctgctgcctgcccactcctggcactgcctctgtgccctggaccgctgctcacgcatggcacccctgctcagccgctcctatttggccgtctgggctctgtcgagcctgcttgtcttcctgctcatggtggctgtgtacacccgcattttcttctacgtgcggcggcgagtgcagcgcatggcagagcatgtcagctgccacccccgctaccgagagaccacgctcagcctggtcaagactgttgtcatcatcctgggggcgttcgtggtctgctggacaccaggccaggtggtactgctcctggatggtttaggctgtgagtcctgcaatgtcctggctgtagaaaagtacttcctactgttggccgaggccaactccctggtcaatgctgctgtgtactcttgccgagatgctgagatgcgccgcaccttccgccgccttctctgctgcgcgtgcctccgccagtccacccgcgagtctgtccactatacatcctctgcccagggaggtgccagcactcgcatcatgcttcccgagaacggccacccactgatggactccaccctttagctaccttgaacttcagcggtacgcggcaagcaacaaatccacagcccctgatgacttgtgggtgctcctggctcaacccaaccaacaggactgactgactggcaggacaaggtctggcatggcacagcaccactgccaggcctccccaggcacaccactctgcccagggaatgggggctttgggtcatctcccactgcctgggggagtcagatggggtgcaggaatctggctcttcagccatctcaggtttagggggtttgtaacagacattattctgttttcactgcgtatccttggtaagccctgtggactggttcctgctgtgtgatgctgagggttttaaggtggggagagataagggctctctcgggccatgctacccggtatgactgggtaatgaggacagactgtggacaccccatctacctgagtctgattctttagcagcagagactgaggggtgcagagtgtgagctgggaaaggtttgtggctccttgcagcctccagggactggcctgtccccgatagaattgaagcagtccacggggaggggatgatacaaggagtaaacctttctttacactc

SEQ ID NO: 150308 - DNA, 480 bp, Homo sapiens
  Payload ID: 9676
  Gene Symbol: LPAR2
  Gene Name: lysophosphatidic acid receptor 2
  ENST ID: ENST00000592061
  CDS Start-End: 405-480
actccgatcacctccacgcctcggcaccgccccctcgcagggttctagcaagtgacctcacccttgtgtgcacacgctcccgggtctctgctccctacactgactccggcaccaaagtgatcctccctcatctcttcccgcagctcacacccctttgtctttccctaaccctcctctccccacaacccaaaccgggtcacacattggcggcaggtgggctgggattcgaccatagatgggttttgtttcacttctggttcaaaaacctattgacttgggtgatgtcttgcacacaggtcttattagtaggtaagaaacagctgctcctccacctccaccccagccccatggagcttgctttttccaggccaccgtagtcctcaccactgccactttgcttcgagatggtcatcatgggccagtgctactacaacgagaccatcggcttcttctataacaacagtggcaaagagctcagct

SEQ ID NO: 150309 - DNA, 1823 bp, Homo sapiens
  Payload ID: 9676
  Gene Symbol: LPAR2
  Gene Name: lysophosphatidic acid receptor 2
  Uniprot ID: Q9HBW0
  ENST ID: ENST00000586703
  CDS Start-End: 180-1235
cgcacagggcgcacccggacgctctaccgctcccgccgcagtcgccgggccatgggcctcgagcccgccccgaacccccgcgagcccgccttgtctgcggcgtgactggaggcccagctgccgcccctccctgtgtccttccaagaagtgccacatgcactgatctcttgtgtccccagatggtcatcatgggccagtgctactacaacgagaccatcggcttcttctataacaacagtggcaaagagctcagctcccactggcggcccaaggatgtggtcgtggtggcactggggctgaccgtcagcgtgctggtgctgctgaccaatctgctggtcatagcagccatcgcctccaaccgccgcttccaccagcccatctactacctgctcggcaatctggccgcggctgacctcttcgcgggcgtggcctacctcttcctcatgttccacactggtccccgcacagcccgactttcacttgagggctggttcctgcggcagggcttgctggacacaagcctcactgcgtcggtggccacactgctggccatcgccgtggagcggcaccgcagtgtgatggccgtgcagctgcacagccgcctgccccgtggccgcgtggtcatgctcattgtgggcgtgtgggtggctgccctgggcctggggctgctgcctgcccactcctggcactgcctctgtgccctggaccgctgctcacgcatggcacccctgctcagccgctcctatttggccgtctgggctctgtcgagcctgcttgtcttcctgctcatggtggctgtgtacacccgcattttcttctacgtgcggcggcgagtgcagcgcatggcagagcatgtcagctgccacccccgctaccgagagaccacgctcagcctggtcaagactgttgtcatcatcctgggggcgttcgtggtctgctggacaccaggccaggtggtactgctcctggatggtttaggctgtgagtcctgcaatgtcctggctgtagaaaagtacttcctactgttggccgaggccaactccctggtcaatgctgctgtgtactcttgccgagatgctgagatgcgccgcaccttccgccgccttctctgctgcgcgtgcctccgccagtccacccgcgagtctgtccactatacatcctctgcccagggaggtgccagcactcgcatcatgcttcccgagaacggccacccactgatggactccaccctttagctaccttgaacttcagcggtacgcggcaagcaacaaatccacagcccctgatgacttgtgggtgctcctggctcaacccaaccaacaggactgactgactggcaggacaaggtctggcatggcacagcaccactgccaggcctccccaggcacaccactctgcccagggaatgggggctttgggtcatctcccactgcctgggggagtcagatggggtgcaggaatctggctcttcagccatctcaggtttagggggtttgtaacagacattattctgttttcactgcgtatccttggtaagccctgtggactggttcctgctgtgtgatgctgagggttttaaggtggggagagataagggctctctcgggccatgctacccggtatgactgggtaatgaggacagactgtggacaccccatctacctgagtctgattctttagcagcagagactgaggggtgcagagtgtgagctgggaaaggtttgtggctccttgcagcctccagggactggcctgtccccgatagaattgaagcagtccacggggaggggatgatacaaggagtaaacctttctttacactct

SEQ ID NO: 150310 - DNA, 558 bp, Homo sapiens
  Payload ID: 9676
  Gene Symbol: LPAR2
  Gene Name: lysophosphatidic acid receptor 2
  ENST ID: ENST00000588233
  CDS Start-End: 335-558
aaaaccctagcgtgcgcccgatgatcagctggggccgcagaggtgggcctcgcacaggaggccgcggctcgctgatactgcgagctggcaaagccgaagctgggcgggggtccgggcggtgggagccaagtcggatcagggagtggcttgtaactcggcggccgattggacacgaagaagagagcggggtggggctgggagggttgggggtccggagcgggggcgcggacccaagaccacctggagctccgcccgggcagcgcggggtcacggcgggaattttcgggtcgccgagtgactcagccccgcaggctcgaaactgcgggcgcatgagatggtcatcatgggccagtgctactacaacgagaccatcggcttcttctataacaacagtggcaaagagctcagctcccactggcggcccaaggatgtggtcgtggtggcactggggctgaccgtcagcgtgctggtgctgctgaccaatctgctggtcatagcagccatcgcctccaaccgccgcttccaccagcccatctactacctgctcggcaatctggc

SEQ ID NO: 150311 - DNA, 609 bp, Homo sapiens
  Payload ID: 9676
  Gene Symbol: LPAR2
  Gene Name: lysophosphatidic acid receptor 2
  ENST ID: ENST00000588461
  CDS Start-End: 549-609
aagaccacctggagctccgcccgggcagcgcggggtcacggcgggaattttcgggtcgccgagtgactcagccccgcaggctcgaaactgcgggcgcatgagcaacccgcacagggcgcacccggacgctctaccgctcccgccgcagtcgccgggccatgggcctcgagcccgccccgaacccccgcgagcccgccttgtctgcggcgtgactggaggcccagtctggagacgcctggaggcccggccatccatcccttccccaaccgctgtctttgtcccggagaccgccagtgtcctccgtcccacccggaacagcctattgccccgcccgcttgggaagcactcgcgcccaaatcccgccgactaacttctggggccgcctctctgtccactccgatcacctccacgcctcggcaccgccccctcgcagggttctagtcttattagtaggtaagaaacagctgctcctccacctccaccccagccccatggagcttgctttttccaggccaccgtagtcctcaccactgccactttgcttcgagatggtcatcatgggccagtgctactacaacgagaccatcggcttcttctataacaacagtg

SEQ ID NO: 150312 - DNA, 585 bp, Homo sapiens
  Payload ID: 9676
  Gene Symbol: LPAR2
  Gene Name: lysophosphatidic acid receptor 2
  ENST ID: ENST00000591042
  CDS Start-End: 345-585
agcaacccgcacagggcgcacccggacgctctaccgctcccgccgcagtcgccgggccatgggcctcgagcccgccccgaacccccgcgagcccgccttgtctgcggcgtgactggaggcccaggtcttattagtaggtaagaaacagctgctcctccacctccaccccagccccatggagcttgctttttccaggccaccgtagtcctcaccactgccactttgcttcgaggtatctgaatttgagacccttgtccttcctgcgctgaccctcctctgcagctgccgcccctccctgtgtccttccaagaagtgccacatgcactgatctcttgtgtccccagatggtcatcatgggccagtgctactacaacgagaccatcggcttcttctataacaacagtggcaaagagctcagctcccactggcggcccaaggatgtggtcgtggtggcactggggctgaccgtcagcgtgctggtgctgctgaccaatctgctggtcatagcagccatcgcctccaaccgccgcttccaccagcccatctactacctgctcggcaatctggccgcggctgacctcttcg

SEQ ID NO: 150313 - DNA, 1720 bp, Homo sapiens
  Payload ID: 9677
  Gene Symbol: LPAR3
  Gene Name: lysophosphatidic acid receptor 3
  Uniprot ID: Q9UBY5
  ENST ID: ENST00000370611
  CDS Start-End: 217-1278
aaactttcctttggctctggacgcgtcgcaggggtcgctggagaggaggcgctccgcccgcccgccgcgtcctccgctgcttctccgcgcccggctggagcccggcgcccggtcgccccgtcgcgctcgaccccgagggcatgcggcagccgcaggggcccccgctcccgggctcggcggcgcgggtgaacgtgagcggatgttcacttctccacaatgaatgagtgtcactatgacaagcacatggactttttttataataggagcaacactgatactgtcgatgactggacaggaacaaagcttgtgattgttttgtgtgttgggacgtttttctgcctgtttatttttttttctaattctctggtcatcgcggcagtgatcaaaaacagaaaatttcatttccccttctactacctgttggctaatttagctgctgccgatttcttcgctggaattgcctatgtattcctgatgtttaacacaggcccagtttcaaaaactttgactgtcaaccgctggtttctccgtcaggggcttctggacagtagcttgactgcttccctcaccaacttgctggttatcgccgtggagaggcacatgtcaatcatgaggatgcgggtccatagcaacctgaccaaaaagagggtgacactgctcattttgcttgtctgggccatcgccatttttatgggggcggtccccacactgggctggaattgcctctgcaacatctctgcctgctcttccctggcccccatttacagcaggagttaccttgttttctggacagtgtccaacctcatggccttcctcatcatggttgtggtgtacctgcggatctacgtgtacgtcaagaggaaaaccaacgtcttgtctccgcatacaagtgggtccatcagccgccggaggacacccatgaagctaatgaagacggtgatgactgtcttaggggcgtttgtggtatgctggaccccgggcctggtggttctgctcctcgacggcctgaactgcaggcagtgtggcgtgcagcatgtgaaaaggtggttcctgctgctggcgctgctcaactccgtcgtgaaccccatcatctactcctacaaggacgaggacatgtatggcaccatgaagaagatgatctgctgcttctctcaggagaacccagagaggcgtccctctcgcatcccctccacagtcctcagcaggagtgacacaggcagccagtacatagaggatagtattagccaaggtgcagtctgcaataaaagcacttcctaaactctggatgcctctcggcccacccaggcctcctctgggaaaagagctgttaagaatgattacctgtctctaacaaagcccatgtacagtgttatttgaggtctccattaatcactgctagatttctttaaaaaattttttttcatagtttaaaagcatgggcagtaaagagaggacctgctgcatttagagaaagcacagaaacgggagaggttcggcgggtccctgcttgtcctatgaactgctcagagctcctgtcagtccagctgggccttctgggttctggcaccatttcgtagccattctctttgtattttaaaaggacgttatgaaagggcttagaccaaaataaatcataatgttacttgagccaccttatatagctgcttggagagtctatgtagttctttctgcatgcattaaaaatgtttagaaatgcttc

SEQ ID NO: 150314 - DNA, 3345 bp, Homo sapiens
  Payload ID: 9677
  Gene Symbol: LPAR3
  Gene Name: lysophosphatidic acid receptor 3
  Uniprot ID: Q9UBY5
  ENST ID: ENST00000440886
  CDS Start-End: 40-1101
cttctttaaatttctttctaggatgttcacttctccacaatgaatgagtgtcactatgacaagcacatggactttttttataataggagcaacactgatactgtcgatgactggacaggaacaaagcttgtgattgttttgtgtgttgggacgtttttctgcctgtttatttttttttctaattctctggtcatcgcggcagtgatcaaaaacagaaaatttcatttccccttctactacctgttggctaatttagctgctgccgatttcttcgctggaattgcctatgtattcctgatgtttaacacaggcccagtttcaaaaactttgactgtcaaccgctggtttctccgtcaggggcttctggacagtagcttgactgcttccctcaccaacttgctggttatcgccgtggagaggcacatgtcaatcatgaggatgcgggtccatagcaacctgaccaaaaagagggtgacactgctcattttgcttgtctgggccatcgccatttttatgggggcggtccccacactgggctggaattgcctctgcaacatctctgcctgctcttccctggcccccatttacagcaggagttaccttgttttctggacagtgtccaacctcatggccttcctcatcatggttgtggtgtacctgcggatctacgtgtacgtcaagaggaaaaccaacgtcttgtctccgcatacaagtgggtccatcagccgccggaggacacccatgaagctaatgaagacggtgatgactgtcttaggggcgtttgtggtatgctggaccccgggcctggtggttctgctcctcgacggcctgaactgcaggcagtgtggcgtgcagcatgtgaaaaggtggttcctgctgctggcgctgctcaactccgtcgtgaaccccatcatctactcctacaaggacgaggacatgtatggcaccatgaagaagatgatctgctgcttctctcaggagaacccagagaggcgtccctctcgcatcccctccacagtcctcagcaggagtgacacaggcagccagtacatagaggatagtattagccaaggtgcagtctgcaataaaagcacttcctaaactctggatgcctctcggcccacccaggcctcctctgggaaaagagctgttaagaatgattacctgtctctaacaaagcccatgtacagtgttatttgaggtctccattaatcactgctagatttctttaaaaaattttttttcatagtttaaaagcatgggcagtaaagagaggacctgctgcatttagagaaagcacagaaacgggagaggttcggcgggtccctgcttgtcctatgaactgctcagagctcctgtcagtccagctgggccttctgggttctggcaccatttcgtagccattctctttgtattttaaaaggacgttatgaaagggcttagaccaaaataaatcataatgttacttgagccaccttatatagctgcttggagagtctatgtagttctttctgcatgcattaaaaatgtttagaaatgcttcagcaatggtgtttttttcctcaaagaaaccatggccagtagctaggtgttcagtaggaatcaaagaaaaatcagtaagagctccagattaaacctgatttttaactgaaggaacattctgaggaaaaatacttaaaagtaaaaaaggtcaatgtgaaaaccctttttgacctgaaaaaggccttagtatggtcctccatgcatgtgtgtgtatatgcatgtgtgtgtgtgtgtgtgtgtgtgtctatatatatatatatatatatatatatatatattcctgtttttactgatttttattgattttgttcaaagatatctggggattggattggggaatgcttaatctgactattgaaagaaacatggatccctggagtatttcagatacggggttaccgccccagactgcctcccgccagtccacattagttctcattttccctcatgatggtgaaaaacagtggagagctagtaaagggtttatgcagaaaacaaggagaagagaatgtgaagtttgaagtgcctatggaacatccagctgataatcttgcctagtaagagcaaaagaagccaagagaacaccaacgtttaaggagcaggtagagaaaacccagcaaaaggacagaggaataagaggaccaaagaacaatgttaagaatcaaggagagaggtcaggcacgctggctcatgcctgtaatcccagcactttgggaggctgaggcaggtggatcacttgaggccaggagtatgagaccagcctgggcaatgtggtgaaattgcatctttactaaaaatacaaaaactagccaggcatggtggcacatgcctgtaataccaggtacttgggaagctgaggcataagaatcacttgaacccgggaggtggaggttgcagagtgagccaagatcgcagcactgcactctagtctgggtgacagagcaagactctgtctcaaaaaaaaaaaaaaaaaaaaaaaaagactagagaatgtcagggaacacatgtgtatatttaaacaacttcactttgcatttaaaaactcgaaggacagcgaaggtgaaatcaattcacgggccacctagactttccagtctaggactagagctgtagcaatgatctgttgtgctgtacaagaaaagagaaagaggtgttcatttgagaacagatgtttttatacatcagagtaaaagctgtattgaagagcaggctgaatcccttccatatagaatgaaatatgagcttgaccccagtccttatcttcagttacctccataccaactggtggcatgttggatttagcatgtagaataatttcccatctcttatttttcccaaggttaatggcatccttctggtacctggcttacatgtgaactgaattttgatctgggttctattttgaatttttctccttcagagacctaagtaggcaacatgaaagacaagtagttaagaaagaaaaaatgatgtttcatacacacaggctaccaacgagagttttctatgtaaaacatttagagtgtattctgatttaaaatgagaataacttcaaggtagatattatagtatttatgtagtttgcaaaagaagtttacatttttttgctattgtgatataacatttatgtgcaagaactacttgtaataaaaggatttgagatgtcatgcttctaaatataatagcctaaaatagagaatattatgatttgaaagtgtagatttcacaaactctgtatagtatgtgggtctatctgaagcttttatcgaagctacctataaaataaaattttaaaagatctgt

SEQ ID NO: 150315 - DNA, 2611 bp, Homo sapiens
  Payload ID: 9678
  Gene Symbol: LPAR4
  Gene Name: lysophosphatidic acid receptor 4
  Uniprot ID: Q99677
  ENST ID: ENST00000435339
  CDS Start-End: 387-1499
gtcctgtttgctaaaggcatgcgggctacagcattcaagagagggagtcgttaacaaagggaaagagataaatgtaaataagctcacatttacagaatgagcggtttgcagtaaaaagctgcggcagcccagagtctgctactttaggctgggctaacctttccctgtaaaaaaaaaaaaaaaaaaaaaaaaaaaaaaatggataaaaatatgcacttccaaagggcgagttgcccatttacatgtttattagctaattatctacaggcatcagcacattctctcatctagcacactctttcttggggaggaaaatatttcctaccggtccatagtgtcagagtggtgaacccctgcagccagcaggcctcctgaaaaaaaagtccatgggtgacagaagattcattgacttccaattccaagattcaaattcaagcctcagacccaggttgggcaatgctactgccaataatacttgcattgttgatgattccttcaagtataatctcaatggtgctgtctacagtgttgtattcatcttgggtctgataaccaacagtgtctctctgtttgtcttctgtttccgcatgaaaatgagaagtgagactgctatttttatcaccaatctagctgtctctgatttgctttttgtctgtacactaccttttaaaatattttacaacttcaaccgccactggccttttggtgacaccctctgcaagatctctggaactgcattccttaccaacatctatgggagcatgctctttctcacctgtattagtgtggatcgtttcctggccattgtctatccttttcgatctcgtactattaggactaggaggaattctgccattgtgtgtgctggtgtctggatcctagtcctcagtggcggtatttcagcctctttgttttccaccactaatgtcaacaatgcaaccaccacctgctttgaaggcttctccaaacgtgtctggaagacttatttatccaagatcacaatatttattgaagttgttgggtttatcattcctctaatattgaatgtctcttgctcttctgtggtgctgagaactcttcgcaagcctgctactctgtctcaaattgggaccaataagaaaaaagtactgaaaatgatcacagtacatatggcagtctttgtggtatgctttgtaccctacaactctgtcctcttcttgtatgccctggtgcgctcccaagctattactaattgctttttggaaagatttgcaaagatcatgtacccaatcaccttgtgccttgcaactctgaactgttgttttgaccctttcatctattacttcacccttgaatcctttcagaagtccttctacatcaatgcccacatcagaatggagtccctgtttaagactgaaacacctttgaccacaaagccttcccttccagctattcaagaggaagtgagtgatcaaacaacaaataatggtggtgaattaatgctagaatccaccttttaggtatgagaaatgtgttcaggtccagatatggtttctcctataatttttcctatgctataaactaaagatttgaagctaatgatactgagaataatgcaccaaatccagtcagatacatttgtttgaaggtatactgtagagtttttattgctgttttgttcagtaattataggtcaaatctaattacaacaaccaagatggattgccaaactcttctgcttggttggaatttcattgtatcgcattatccaggtggctagtggcatttgataatatagagatgactttgaaactttcaaaaaggtatttctattccaatgatatttggtaattaggttgggcctataaatatagaacaaattcagggatttttaaaaaattgtgttactactgatatatgctagttttattttatttttttgaactgtcattgagtttattttagcacaagaatatttttagcctaacattattaataagaaatgtgtcaaatttttaacattggtaaaatatgttatgtgcattttgaaaacagaaaacaaattgcgttggcatgtacgtgggtgggaagaaaaagaaaattaacaggatttacacaattataatcaccagcagtgtgagtttaaaaaacttcgttgtttttacaccaaattaaaattttcatgtcaaacttcaaagccagaaagctgctaaatacgtgtctggcaggtaaaagctggaaaattacttaaaacaggaaagtgtcaataaaaaaacttgagcaacaccaacatattttttcttaaaatgtcacgttatcttcattttgggaaactaggttctataaaatatttatcctccctgttatactttggagcacagcacagccagaaaggggctgcatttgtgcccaggtcaggagcaaattgaaaaaaaaaataaagtaatacaaaaaaatcaaactataaagcaaaaacatttattaaaacctgaattaatcctttttggagggaggagtagagatatataacctgaaaatacttattctttcttatcgaattttggagcctaatatagccaggagctgctgaatttgtgcccctggattggaagcaaataaaaaaaaaaaacaa

SEQ ID NO: 150316 - DNA, 672 bp, Homo sapiens
  Payload ID: 9678
  Gene Symbol: LPAR4
  Gene Name: lysophosphatidic acid receptor 4
  ENST ID: ENST00000514744
  CDS Start-End: 536-672
ctgtttgctaaaggcatgcgggctacagcattcaagagagggagtcgttaacaaagggaaagagataaatgtaaataagctcacatttacagaatgagcggtttgcagtaaaaagctgcggcagcccagagtctgctactttaggctgggctaacctttccctgtaaaaaaaaaaaaaaaaaaaaaaaaaaaaaaatggataaaaatatgcacttccaaagggcgagttgcccatttacatgtttattagctaattatctacaggcatcagcacattctctcatctagcacactctttcttggggaagacagatttctggaggagtgtgaaaatcaactctccttaatattaagcacccattggaggaaatctctaactacagtgcctccaggaaactcattggttattccagtcttagataaaattggtgccaggatttggttcgaactaatgtggaggaaaatatttcctaccggtccatagtgtcagagtggtgaacccctgcagccagcaggcctcctgaaaaaaaagtccatgggtgacagaagattcattgacttccaattccaagattcaaattcaagcctcagacccaggttgggcaatgctactgccaataatacttgcattgttgatgattccttcaagtataatctcaatggtgctgtcta

SEQ ID NO: 150317 - DNA, 2155 bp, Homo sapiens
  Payload ID: 9678
  Gene Symbol: LPAR4
  Gene Name: lysophosphatidic acid receptor 4
  Uniprot ID: Q99677
  ENST ID: ENST00000614823
  CDS Start-End: 621-1733
ggacttcaggcctttttgtgtcctgtttgctaaaggcatgcgggctacagcattcaagagagggagtcgttaacaaagggaaagagataaatgtaaataagctcacatttacagaatgagcggtttgcagtaaaaagctgcggcagcccagagtctgctactttaggctgggctaacctttccctgtaaaaaaaaaaaaaaaaaaaaaaaaaaaaaaatggataaaaatatgcacttccaaagggcgagttgcccatttacatgtttattagctaattatctacaggcatcagcacattctctcatctagcacactctttcttggggaagacagatttctggaggagtgtgaaaatcaactctccttaatattaaggaccctgcccaatggtaacagttgttgccaagaaaagaaaaaaagaaaaaaaaaagacccaatcacccattggaggaaatctctaactacagtgcctccaggaaactcattggttattccagtcttagataaaattggtgccaggatttggttcgaactaatgtggaggaaaatatttcctaccggtccatagtgtcagagtggtgaacccctgcagccagcaggcctcctgaaaaaaaagtccatgggtgacagaagattcattgacttccaattccaagattcaaattcaagcctcagacccaggttgggcaatgctactgccaataatacttgcattgttgatgattccttcaagtataatctcaatggtgctgtctacagtgttgtattcatcttgggtctgataaccaacagtgtctctctgtttgtcttctgtttccgcatgaaaatgagaagtgagactgctatttttatcaccaatctagctgtctctgatttgctttttgtctgtacactaccttttaaaatattttacaacttcaaccgccactggccttttggtgacaccctctgcaagatctctggaactgcattccttaccaacatctatgggagcatgctctttctcacctgtattagtgtggatcgtttcctggccattgtctatccttttcgatctcgtactattaggactaggaggaattctgccattgtgtgtgctggtgtctggatcctagtcctcagtggcggtatttcagcctctttgttttccaccactaatgtcaacaatgcaaccaccacctgctttgaaggcttctccaaacgtgtctggaagacttatttatccaagatcacaatatttattgaagttgttgggtttatcattcctctaatattgaatgtctcttgctcttctgtggtgctgagaactcttcgcaagcctgctactctgtctcaaattgggaccaataagaaaaaagtactgaaaatgatcacagtacatatggcagtctttgtggtatgctttgtaccctacaactctgtcctcttcttgtatgccctggtgcgctcccaagctattactaattgctttttggaaagatttgcaaagatcatgtacccaatcaccttgtgccttgcaactctgaactgttgttttgaccctttcatctattacttcacccttgaatcctttcagaagtccttctacatcaatgcccacatcagaatggagtccctgtttaagactgaaacacctttgaccacaaagccttcccttccagctattcaagaggaagtgagtgatcaaacaacaaataatggtggtgaattaatgctagaatccaccttttaggtatgagaaatgtgttcaggtccagatatggtttctcctataatttttcctatgctataaactaaagatttgaagctaatgatactgagaataatgcaccaaatccagtcagatacatttgtttgaaggtatactgtagagtttttattgctgttttgttcagtaattataggtcaaatctaattacaacaaccaagatggattgccaaactcttctgcttggttggaatttcattgtatcgcattatccaggtggctagtggcatttgataatatagagatgactttgaaactttcaaaaaggtatttctattccaatgatatttggtaattaggttgggcctataaatatagaacaaattcagggatttttaaaaaattgtgttactactgatatatgctagttttattttatttttttg

SEQ ID NO: 150318 - DNA, 3171 bp, Homo sapiens
  Payload ID: 9679
  Gene Symbol: LPAR5
  Gene Name: lysophosphatidic acid receptor 5
  Uniprot ID: Q9H1C0
  ENST ID: ENST00000329858
  CDS Start-End: 758-1876
agtgggaggcaggacctagcagagcactgtcatgaagagggccccgggcagggtggggcacaagccacgagtggcatggactaagccacgagtagcatggactaaaccacctggcagacctaggaaaggaagacagacacccagggggaaccggtgaggacagcgagaggctggtgggttagtcatctggcatcagacggtgggtgtgccaggaagagttcccagacacagcaggaatatctgaacgatgggtgggggcagttcctagtcggggctggattaagtatccttagctgctggggtttcttctctggccagtccgtgaaggcctctgagggcaatgcttcctcttcactctctccttggcccgtgtggggttgggtgagtgcactgagctgggagggatgggctgagatctgctgaggtgggtgtgtcccctcccgccctgggagcaggtcctaccagcccagcccagcccagcccagcccagagcaggcagcggaagccagcttggggcagcgcagagcaacacggagcacaggtctctgctgctgatgaagctgtgaccaaacgcacccaacccttggcagccatctgtccctgcagccatagcccacattcccatgacctccctctgcttgttttgggaccatgtctgtacagcctctaggccccagccccggaggtgaatgccatgccatgattctggtgtgctccatggcatccccagcctagctcccaatcccactttggcacgatgttagccaacagctcctcaaccaacagttctgttctcccgtgtcctgactaccgacctacccaccgcctgcacttggtggtctacagcttggtgctggctgccgggctccccctcaacgcgctagccctctgggtcttcctgcgcgcgctgcgcgtgcactcggtggtgagcgtgtacatgtgtaacctggcggccagcgacctgctcttcaccctctcgctgcccgttcgtctctcctactacgcactgcaccactggcccttccccgacctcctgtgccagacgacgggcgccatcttccagatgaacatgtacggcagctgcatcttcctgatgctcatcaacgtggaccgctacgccgccatcgtgcacccgctgcgactgcgccacctgcggcggccccgcgtggcgcggctgctctgcctgggcgtgtgggcgctcatcctggtgtttgccgtgcccgccgcccgcgtgcacaggccctcgcgttgccgctaccgggacctcgaggtgcgcctatgcttcgagagcttcagcgacgagctgtggaaaggcaggctgctgcccctcgtgctgctggccgaggcgctgggcttcctgctgcccctggcggcggtggtctactcgtcgggccgagtcttctggacgctggcgcgccccgacgccacgcagagccagcggcggcggaagaccgtgcgcctcctgctggctaacctcgtcatcttcctgctgtgcttcgtgccctacaacagcacgctggcggtctacgggctgctgcggagcaagctggtggcggccagcgtgcctgcccgcgatcgcgtgcgcggggtgctgatggtgatggtgctgctggccggcgccaactgcgtgctggacccgctggtgtactactttagcgccgagggcttccgcaacaccctgcgcggcctgggcactccgcaccgggccaggacctcggccaccaacgggacgcgggcggcgctcgcgcaatccgaaaggtccgccgtcaccaccgacgccaccaggccggatgccgccagtcaggggctgctccgaccctccgactcccactctctgtcttccttcacacagtgtccccaggattccgccctctgaacacacatgccattgcgctgtccgtgcccgactcccaacgcctctcgttctgggaggcttacagggtgtacacacaagaaggtgggctgggcacttggacctttgggtggcaattccagcttagcaacgcagaagagtacaaagtgtggaagccagggcccagggaaggcagtgctgctggaaatggcttctttaaactgtgagcacgcagagcaccccttctccagcggtgggaagtgatgcagagagcccacccgtgcagagggcagaagaggacgaaatgcctttgggtgggcagggcattaaactgctaaaagctggttagatggaacagaaaatgggcattctggatctaaaccgccacaggggcctgagagctgaagagcaccaggtttggtggacaaagctactgagatgcctgttcatctgctgacttctgtctaggctcatggatgccaccccctttcatttcggcctaggcttcccctgctcaccactgaggcctaatacaagagttcctatggacagaactacattctttctcgcatagtgacttgtgacaatttagacttggcatccagcatgggatagttggggcaaggcaaaactaacttagagtttccccctcaacaacatccaagtccaaaccctttttaggttatcctttcttccatcacatccccttttccaggcctcctccattttaggtccttaatattctttctttttctctctctctcgtttctctcttctctctcctctcctctcctctctcttctcctcttctctctctctccctctctctcctttgtccagagtaaggataaaattctttctactaaagcactggttctcaaactttttggtctcagaccccactcttagaaattgaggatctcaaagagctttgcttatattttgttcttttgatacttaccatactagaaattaaagcgaatacatttttaaaataaatacacatgcacacattacattagccatgggagcaataatgtcaccacacacacttcatgaagcctctggaaaactctacagtatacttgtgagagaatgagagtgaaagggacaaataacatctgtgtagcagtattatgaaaatagcttgacctcgtggacttcctcagagggttggtccctggatcacactttgagaaccatacttgtcctgaagtattggagttcatgtctaacttcttcccagggcattatgtacagtgctttttattactgtggggagagggcagtgctaaataaattaatcactactgatagtc

SEQ ID NO: 150319 - DNA, 2695 bp, Homo sapiens
  Payload ID: 9679
  Gene Symbol: LPAR5
  Gene Name: lysophosphatidic acid receptor 5
  Uniprot ID: Q9H1C0
  ENST ID: ENST00000431922
  CDS Start-End: 282-1400
agcaaagagcagtgcccagcccagctcagagggcaaatgggacagatcccagaggccctgaggaggtctctgctgctgatgaagctgtgaccaaacgcacccaacccttggcagccatctgtccctgcagccatagcccacattcccatgacctccctctgcttgttttgggaccatgtctgtacagcctctaggccccagccccggaggtgaatgccatgccatgattctggtgtgctccatggcatccccagcctagctcccaatcccactttggcacgatgttagccaacagctcctcaaccaacagttctgttctcccgtgtcctgactaccgacctacccaccgcctgcacttggtggtctacagcttggtgctggctgccgggctccccctcaacgcgctagccctctgggtcttcctgcgcgcgctgcgcgtgcactcggtggtgagcgtgtacatgtgtaacctggcggccagcgacctgctcttcaccctctcgctgcccgttcgtctctcctactacgcactgcaccactggcccttccccgacctcctgtgccagacgacgggcgccatcttccagatgaacatgtacggcagctgcatcttcctgatgctcatcaacgtggaccgctacgccgccatcgtgcacccgctgcgactgcgccacctgcggcggccccgcgtggcgcggctgctctgcctgggcgtgtgggcgctcatcctggtgtttgccgtgcccgccgcccgcgtgcacaggccctcgcgttgccgctaccgggacctcgaggtgcgcctatgcttcgagagcttcagcgacgagctgtggaaaggcaggctgctgcccctcgtgctgctggccgaggcgctgggcttcctgctgcccctggcggcggtggtctactcgtcgggccgagtcttctggacgctggcgcgccccgacgccacgcagagccagcggcggcggaagaccgtgcgcctcctgctggctaacctcgtcatcttcctgctgtgcttcgtgccctacaacagcacgctggcggtctacgggctgctgcggagcaagctggtggcggccagcgtgcctgcccgcgatcgcgtgcgcggggtgctgatggtgatggtgctgctggccggcgccaactgcgtgctggacccgctggtgtactactttagcgccgagggcttccgcaacaccctgcgcggcctgggcactccgcaccgggccaggacctcggccaccaacgggacgcgggcggcgctcgcgcaatccgaaaggtccgccgtcaccaccgacgccaccaggccggatgccgccagtcaggggctgctccgaccctccgactcccactctctgtcttccttcacacagtgtccccaggattccgccctctgaacacacatgccattgcgctgtccgtgcccgactcccaacgcctctcgttctgggaggcttacagggtgtacacacaagaaggtgggctgggcacttggacctttgggtggcaattccagcttagcaacgcagaagagtacaaagtgtggaagccagggcccagggaaggcagtgctgctggaaatggcttctttaaactgtgagcacgcagagcaccccttctccagcggtgggaagtgatgcagagagcccacccgtgcagagggcagaagaggacgaaatgcctttgggtgggcagggcattaaactgctaaaagctggttagatggaacagaaaatgggcattctggatctaaaccgccacaggggcctgagagctgaagagcaccaggtttggtggacaaagctactgagatgcctgttcatctgctgacttctgtctaggctcatggatgccaccccctttcatttcggcctaggcttcccctgctcaccactgaggcctaatacaagagttcctatggacagaactacattctttctcgcatagtgacttgtgacaatttagacttggcatccagcatgggatagttggggcaaggcaaaactaacttagagtttccccctcaacaacatccaagtccaaaccctttttaggttatcctttcttccatcacatccccttttccaggcctcctccattttaggtccttaatattctttctttttctctctctctcgtttctctcttctctctcctctcctctcctctctcttctcctcttctctctctctccctctctctcctttgtccagagtaaggataaaattctttctactaaagcactggttctcaaactttttggtctcagaccccactcttagaaattgaggatctcaaagagctttgcttatattttgttcttttgatacttaccatactagaaattaaagcgaatacatttttaaaataaatacacatgcacacattacattagccatgggagcaataatgtcaccacacacacttcatgaagcctctggaaaactctacagtatacttgtgagagaatgagagtgaaagggacaaataacatctgtgtagcagtattatgaaaatagcttgacctcgtggacttcctcagagggttggtccctggatcacactttgagaaccatacttgtcctgaagtattggagttcatgtctaacttcttcccagggcattatgtacagtgctttttattactgtggggagagggcagtgctaaataaattaatcactactgatagtc

SEQ ID NO: 150320 - DNA, 2428 bp, Homo sapiens
  Payload ID: 9680
  Gene Symbol: LPAR6
  Gene Name: lysophosphatidic acid receptor 6
  Uniprot ID: P43657
  ENST ID: ENST00000345941
  CDS Start-End: 1144-2178
gaagctgaggagaagctgatgccatgcttcctgtacagcctgaagaaccacaaggtcttgatctgtcaccaggctgaagtgcagtggtacaatcaaagctcactgcagtctcaacctcctaggctcaaacaatcctcccacttcagcctcccaaccagctgggaccacaggttgacatcaccacacccaggtctgctggaatttgctggaggtccactccagaccctgtttgtctggatatcaccagcagaggttgcagaacaacaaagattgctgcctgttccttcctctggaagctttgtcccagaggggcacccaccagacggcagctggagctctcctgttccctctgctatggctcttcctcagtagaaacaactggcaacaaaattcaagtttatgattcattcatcagcaaacatgtgagaatcatctacaaagaaccaagaattgtgagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttataaaaccatccaaagatccagataatttgcaaataaattggaggttatagaggttataatctgaatcccaaaggagactgcagctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttaatatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagtt

SEQ ID NO: 150321 - DNA, 3004 bp, Homo sapiens
  Payload ID: 9680
  Gene Symbol: LPAR6
  Gene Name: lysophosphatidic acid receptor 6
  Uniprot ID: P43657
  ENST ID: ENST00000378434
  CDS Start-End: 1626-2660
tggattaggagagcttctggatagctgaacacatggaggtttctggagggtgtggcccccagagggcatggaagctctgcacccctgctcccatacctcaccctacgcatctcctcatctgtatcctttgcaatatcctttgtaataaaccgaaaattttatcataatgagcatcaaaagaatcccaaatgagaaaactgctttttgcataagtgtaaattaagagatggaagtcacatttcaccatggcaaacatttgctgcatgcaaaatgactgaaacaaggtcttgatctgtcaccaggctgaagtgcagtggtacaatcaaagctcactgcagtctcaacctcctaggctcaaacaatcctcccacttcagcctcccaaccagctgggaccacaggttgacatcaccacacccaggtctgctggaatttgctggaggtccactccagaccctgtttgtctggatatcaccagcagaggttgcagaacaacaaagattgctgcctgttccttcctctggaagctttgtcccagaggggcacccaccagacggcagctggagctctcctgtgtgccactggagtacgaaaaagaaaaaatcctgcagctagctcggtgtctgcccaaacggctgcccagttttgtgcttgaaacccagggcctgggtggtgtaggcacccgagggaattgcctggtctaagggttgtgaagatcacggaaaaggcatagagtctgggccggaatgcatcgttcctcgtggcacattccctcatggcttcccttagctaggggaggaagttccctggccccttgcacttcccgttccctctgctatggctcttcctcagtagaaacaactggcaacaaaattcaagtttatgattcattcatcagcaaacatgtgagaatcatctacaaagaaccaagaattgtgagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttataaaaccatccaaagatccagataatttgcaaataaattggaggttatagaggttataatctgaatcccaaaggagactgcagctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttaatatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagttatttagtgtctaaaagtgactgacttaaattatgtggtgccaatctgtaatgtctttgaattcctttttatattaaatgatttaatttactaaa

SEQ ID NO: 150322 - DNA, 2175 bp, Homo sapiens
  Payload ID: 9680
  Gene Symbol: LPAR6
  Gene Name: lysophosphatidic acid receptor 6
  Uniprot ID: P43657
  ENST ID: ENST00000620633
  CDS Start-End: 800-1834
tccctctgctatggctcttcctcagtagaaacaactggcaacaaaattcaagtttatgattcattcatcagcaaacatgtgagaatcatctacaaagaaccaagaattgtgagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttataaaaccatccaaagatccagataatttgcaaataaattggaggttatagaggttataatctgaatcccaaaggagactgcagctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttaatatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagttatttagtgtctaaaagtgactgacttaaattatgtggtgccaatctgtaatgtctttgaattcctttttatattaaatgatttaatttact

SEQ ID NO: 150323 - DNA, 3966 bp, Homo sapiens
  Payload ID: 9681
  Gene Symbol: LPCAT1
  Gene Name: lysophosphatidylcholine acyltransferase 1
  Uniprot ID: Q8NF37
  ENST ID: ENST00000283415
  CDS Start-End: 134-1738
cgcgcctgcgcgcccggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtcacgctgccacccgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataagtaaaacataaagtctatacttgggaatgat

SEQ ID NO: 150324 - DNA, 5610 bp, Homo sapiens
  Payload ID: 9681
  Gene Symbol: LPCAT1
  Gene Name: lysophosphatidylcholine acyltransferase 1
  Uniprot ID: Q8NF37
  ENST ID: ENST00000475622
  CDS Start-End: 119-1723
ggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtcacgctgccacccgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggagaaagacaacaacaggcattgtgagaggagagccaatccagatgagattttcttggtgtggttctagcatgtttggaaaacacaagaattgaaattctgtagaaaaagctgtcttggtggcaaagggacgctccggagtgttctggtattttgcggacagtagcagacatcttacagagttgaaacatggatggctggctgcctgcctgttctccactcagcattggagccaggagaaatgaaggtgggaccctcaggaaaaagcaaacccacccccggtgttcacgcaagagttgacacagctgcacctgctgctgccgtatgctgatcctaaccagaagctggctgggaggagaggccccctgggccatgaagcagagctcgggaatgtgagaagtggggctgagggcaaacggggtagtgaaggaccagcactgcccacccatagctgctctgtgtccacaagcaggtcagctgcagctctgctccatgtcaccatctgcatccagcccagcacagcagcccctcctgggactcagccagtcagatggctttgggaagaggtgacaagcaagcctgcctagatgctatatctgctgcacagacgcagaatacagcaggcccactcctggttcattggccacagtaagccatgtggtcacagctgaattcaacagccagagacgtacagtcctgcaagggagcccctcaaaggaggtgaaggatcttctgaacagcagcaccagccaccctgcagtaagtgttggatgtggtggtgagcagggccagtcctaattccacccattgacattacagacattattctggctatgaaatggtgccatgtcttggtccacagttcgaggcactatgtcatccatcaggatggcagtccaatgttctagggcactgcctccccatgggcagcacacctaaagcttcaagaagtcatcctcatgcttaatcagactcgccacctctgggtgatgggaaacgtagggattccaagtgtgtacctgttcccatgctgcctttgctgtaaagtaaattccttaacaatgccataggaggtgggcaatagtgaataagccattcatcaagcccacagatggtgctgtcagaaacactgacagcaaagacatatccatatctggaataagggaaactgaaaccaagagatactcccctcaatgatggaagagtccagtgtgatcaacctgcctccagggggctggctagtccctttcccaggaatggtacctggggctaagtatgggaccctgcttccgacatgttgggagtccagtgataactgcatcagcctaggctattgttgatgggtcagctctttgttattgatccacactcatctccatccctatttccagtgccagtttgtgaatggttctactaggtaaacactgggttggctgggaaagagacaggctgacatccactgcctgtgtcataccctggcagagactatagtaaattagacccgacaagagaaaatattagtgaacctgaaaatacagctatgtgtgatcccagtgatgtacagggagaaacagacagaaatgaagcacaagtgggcatggaataatgccacaaggcccatcacatgtgattggagccctagaaaaggaggaggacaggacagaaaaattatttgatgaaataatggccagaatttttttccaaatctataaactaagatacccaagaagctcaataagcacccagcagaaaaaatacaataaaaacacagcaagacacacatcacaaactgctgaaagccactgaaaaggagaaaaatcttaaaagcagctggagaaaaacaacatactatcaaggaacagagataagaatgaaagccaacttctcttcagaaactatgcaacccagacgtcaaggaacagagataagaacgacagccgacttctctgcagaaactatgcaacccagacgtcaaggaacagagataagaacgacagccgacttctctgcagaaactatgcaacccagacgtcaaggaacagagataagaacgacagccgacttctctgcagaaactatg

SEQ ID NO: 150325 - DNA, 3698 bp, Homo sapiens
  Payload ID: 9681
  Gene Symbol: LPCAT1
  Gene Name: lysophosphatidylcholine acyltransferase 1
  ENST ID: ENST00000611696
  CDS Start-End: 1-1470
gtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtcacgctgccacccgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataagtaaaacataaagtctatacttgggaatgat

SEQ ID NO: 150326 - DNA, 5357 bp, Homo sapiens
  Payload ID: 9681
  Gene Symbol: LPCAT1
  Gene Name: lysophosphatidylcholine acyltransferase 1
  ENST ID: ENST00000625809
  CDS Start-End: 1-1470
gtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtcacgctgccacccgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggagaaagacaacaacaggcattgtgagaggagagccaatccagatgagattttcttggtgtggttctagcatgtttggaaaacacaagaattgaaattctgtagaaaaagctgtcttggtggcaaagggacgctccggagtgttctggtattttgcggacagtagcagacatcttacagagttgaaacatggatggctggctgcctgcctgttctccactcagcattggagccaggagaaatgaaggtgggaccctcaggaaaaagcaaacccacccccggtgttcacgcaagagttgacacagctgcacctgctgctgccgtatgctgatcctaaccagaagctggctgggaggagaggccccctgggccatgaagcagagctcgggaatgtgagaagtggggctgagggcaaacggggtagtgaaggaccagcactgcccacccatagctgctctgtgtccacaagcaggtcagctgcagctctgctccatgtcaccatctgcatccagcccagcacagcagcccctcctgggactcagccagtcagatggctttgggaagaggtgacaagcaagcctgcctagatgctatatctgctgcacagacgcagaatacagcaggcccactcctggttcattggccacagtaagccatgtggtcacagctgaattcaacagccagagacgtacagtcctgcaagggagcccctcaaaggaggtgaaggatcttctgaacagcagcaccagccaccctgcagtaagtgttggatgtggtggtgagcagggccagtcctaattccacccattgacattacagacattattctggctatgaaatggtgccatgtcttggtccacagttcgaggcactatgtcatccatcaggatggcagtccaatgttctagggcactgcctccccatgggcagcacacctaaagcttcaagaagtcatcctcatgcttaatcagactcgccacctctgggtgatgggaaacgtagggattccaagtgtgtacctgttcccatgctgcctttgctgtaaagtaaattccttaacaatgccataggaggtgggcaatagtgaataagccattcatcaagcccacagatggtgctgtcagaaacactgacagcaaagacatatccatatctggaataagggaaactgaaaccaagagatactcccctcaatgatggaagagtccagtgtgatcaacctgcctccagggggctggctagtccctttcccaggaatggtacctggggctaagtatgggaccctgcttccgacatgttgggagtccagtgataactgcatcagcctaggctattgttgatgggtcagctctttgttattgatccacactcatctccatccctatttccagtgccagtttgtgaatggttctactaggtaaacactgggttggctgggaaagagacaggctgacatccactgcctgtgtcataccctggcagagactatagtaaattagacccgacaagagaaaatattagtgaacctgaaaatacagctatgtgtgatcccagtgatgtacagggagaaacagacagaaatgaagcacaagtgggcatggaataatgccacaaggcccatcacatgtgattggagccctagaaaaggaggaggacaggacagaaaaattatttgatgaaataatggccagaatttttttccaaatctataaactaagatacccaagaagctcaataagcacccagcagaaaaaatacaataaaaacacagcaagacacacatcacaaactgctgaaagccactgaaaaggagaaaaatcttaaaagcagctggagaaaaacaacatactatcaaggaacagagataagaatgaaagccaacttctcttcagaaactatgcaacccagacgtcaaggaacagagataagaacgacagccgacttctctgcagaaactatgcaacccagacgtcaaggaacagagataagaacgacagccgacttctctgcagaaactatgcaacccagacgtcaaggaacagagataagaacgacagccgacttctctgcagaaactatg

SEQ ID NO: 150327 - DNA, 705 bp, Homo sapiens
  Payload ID: 9681
  Gene Symbol: LPCAT1
  Gene Name: lysophosphatidylcholine acyltransferase 1
  ENST ID: ENST00000626646
  CDS Start-End: 1-705
gccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattag

SEQ ID NO: 150328 - DNA, 5391 bp, Homo sapiens
  Payload ID: 9682
  Gene Symbol: LPCAT2
  Gene Name: lysophosphatidylcholine acyltransferase 2
  Uniprot ID: Q7L5N7
  ENST ID: ENST00000262134
  CDS Start-End: 185-1819
agagcctggggcgtgtcacagccgaaggggcagggcggcagcagcaggcgtctaagtaacttcagcgcctgcgcagaggctccccagcgtcgccctaggctgggactctagtaggtcttcggctcagttttggctgcagcgcccgcgtagatcgcttcggccgggttctacgcccggctcaactatgagccggtgcgcccaggcggcggaagtggcggccacagtgccaggtgccggcgtcgggaacgtggggctgcggccgcccatggtgccccgtcaggcgtccttcttcccgccgccggtgccgaaccccttcgtgcagcagacgcagatcggctccgcgaggcgggtccagattgtccttcttgggattatcttgcttccaattcgtgtcttattggttgcgttaattttattacttgcatggccatttgctgcaatttcaacagtatgctgtcctgaaaagctgacccacccaataactggttggaggaggaaaattactcaaacagctttgaaatttctgggtcgtgctatgttcttttcaatgggatttatagttgctgtaaaaggaaagattgcaagtcctttggaagcaccagtttttgttgctgcccctcattcaacattctttgatggaattgcctgtgttgtagctgggttaccttctatggtatctcgaaatgagaatgcacaagtccctctgattggcagactgttacgggctgtgcaaccagttttggtgtcccgtgtagatccggattcccgaaaaaacacaataaatgaaataataaagcgaacaacatcaggaggagaatggccccagatactagttttcccagaaggtacttgtactaatcgttcctgtttgattacttttaaaccaggagccttcattccaggagttccagtgcagccagtcctcctcagatacccaaacaagctggatactgtgacctggacatggcaaggatatacattcattcagctttgtatgcttactttctgccagctcttcacaaaggtagaagttgagtttatgccagttcaagtaccaaatgatgaagaaaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacaggaaccatgatggcagcattgacttccgagagtatgtgattggcctggctgtcttgtgcaacccttccaacacagaggagatcatccaggtggcatttaagctgtttgacgttgatgaggatggctacataacggaggaagagttctccaccattctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaagaagtccagacaaccccctccaccgccagtaataaagtcagccctgaaaagcatgaagagagtacctcagacaaaaaagatgactgaaagcagtatttccaataaggaaaacacagtagcttttgcttgaaattgtaaaggcacttattgataatacttttaatgtgttggtaatgatgtttaaaattgaaagatttttaaaacaaaaatgatagattttcttactaaaaatgtttttattaaccttgcttttattggaaaaaatcaagcaatatttcgttttcttttgtgttatattgtactttactgattcatttactggtgatacatatgtttttatggattttccagtttaatttgcatatacaaatgaatgcaatggtctattggtgagcattgagcaacactgtataaagttttaaaaatgtaaacactttttaatctactttcctctaaaaatcaataatattctattatttctaatccttttccacttgggaaataacaatgaagaatctgagaatttgacatctataactttacagattcatttttccatttaaatttcagtttcttggatcactgaatatgggaagggagagcttcactaattagacgcagcttcttaagaacttatattctctttgacatacatctctattgtagttttttgttttgttttgttttttgagatggagtcttgctctgtcacccaggctggagtgcagtggtgcaatctcagctcactgcaacctctgcctcctgggttcaagtgattctcgtacctcagactcccgagtagttgggattacaggtgcccaccaccacacccgactaatttttgtatttttagtagccatgtggttttgccatgttggccaggctggtttcgaactcctgacctcaggtgatccacccacctcagcctcccaaagtgctgggattacaggtgtgagccaccgttcccggcctattgtagattttcttaactacttgctaaggaaatcatatccttttacatgaactacaggtttagaacttggttttaagacaactgctatggccagaaggtaaatgggaattgccttattgaaggtaacattgattgcctaataagaaaatgaattgtttgccacagagttgaatttaatttgagttagatagttcagaatgtagcacttgccctataaatgaatcagatttgttctatttatataatattagaattaatatattatcatgtaagtgggaattttattttgttaagtggactctcaaattttagaacttgtgtgaaatatctcccagaaaacacaaaaggtttcaaggtatcacccaaagctagggaatcaacaaacgtactttattaatgcaagaccacaatttaagccccaggcaggaatccaacagtaacatttttcctttaggttaagcagtaatttttttgaattgtcatttttaatgggtctcacacatgcatattgctaatatcattcatgtttgaggttttcaacaaagaaccaatttattaatataatgtacaaaaatagttggttcattttctgaattcagtctttgaaataaaactccttgttttggccgtgtttctgaatgtattggtgattcacccccaagctaattttttaaagtcatttttgaagttgggaagtctcatgagagatgttgaagtatgtatttaatcaagagtcatgatttcaaactagttttacatattaagcagttagtgttctaatttaatgggtaaatgtgtgtttggataaatatctgaaaattttatccttaagtatatataattatttgcctcttatatgtcttaaagctatttaaacaaggtgttaaatgagccaaaacaattaagtaattagaacagtacatttttatcagagtgtctgtcatatgcaatgaatgtatgtaatactaaaaaatcatgactacttttatcaaagaaaaaccacacattaatcctattaatcatgaaagcgtagcattgtaaattaaaggttttctttgaggctcttgaaagtgatcccattgctttcctgttttaaaaatattttatgctctttatttccacttctgtgaatgtgatatttctattttgtgattatgttactgaataaacaaacttgctacataaaattcttagcaattaaaaaaattctgattctgccattttgtctcaaatgtaatatacccttttaatatcatatgtttacatatttatgaatgattaatcatttttgtttgcattaaactttatgaaatgtcagaaatgattttactctaatgaaactcaaattttgcccaaagtagcaatattcttaaagatgttgaattttgactggttgaattttatatagtaacacacaagtcgtgatcatcaatattattgcagaccaggactctgcttatatgccttgctaacaaagatttctttcacagaggcttttctcctctcaagacttaaagtaagaattacattttattaagtcagttaaatgcaccatggcttcatatagtaatataaaaaaactctttgaagtgagaaatattatatcctaaaacctctaaaccacaaacattcaattgaaagagttctgttgaaggataatgacatactgactgcttacagaccaagttgcttgcattttgtatgtttagccctcctttgccactgcttttagagccttggaaggctaagtgtgatagtaatgctagctctaatgcatatttaaaggagactgcctcgcttttagaagacatctggtctgctctctgcatgaggcacagcagtaaagctctttgattcccagaatcaagaactctccccttcagactattaccgaatgcaaggtggttaattgaaggccactaattgatgctcaaatagaaggatattgactatattggaacagatggagtctctactacaaaagtctttgggtatttgtttcttacatagaaaatgctaacatgaatagaaagatactggtgcaagaccattcccgggaaagtagacatacttacatttttttccttttctgctcatttgaatgaactcaattttatgttaaattgttatatcagagtgacaaataagtgctatggcttgatagaagtgaagctcttcacatatattcaaaatacatatcacaaactttggtaaataggatagtaatctgaagaacttttgccctttttaccccatttactgtaactcttgtttctaggtaatcgttctctctcaacaaacttctcaagcgtctgtgtaacaagccacatgttctaacaaattgtctccatcgcacttcaacagccaggtccctattttttataacgtattaaccttattattttcttattattttaaaagaatctatgcacattagcaaaatttaaaagatagagaaaaatataaacagaaaaaattatgtttacttctaccaccctaaatcaactattatcaattttatacatattttactccatcttttttcaaagtttcttacattttccaatgtcattaaaattctctgtgaatgtaaattttaaaaactgtacctactgttttttggaaatctgtaacaagctatgtgtaatcattcttctaatattaaacatattgtgtccagaattta

SEQ ID NO: 150329 - DNA, 616 bp, Homo sapiens
  Payload ID: 9682
  Gene Symbol: LPCAT2
  Gene Name: lysophosphatidylcholine acyltransferase 2
  ENST ID: ENST00000564084
  CDS Start-End: 1-566
ctgcccctcattcaacattctttgatggaattgcctgtgttgtagctgggttaccttctatggtatctcgaaatgagaatgcacaagtccctctgattggcagactgttacgggctgtgcaaccagttttggtgtcccgtgtagatccggattcccgaaaaaacacaataaatgaaataataaagcgaacaacatcaggaggagaatggccccagatactagttttcccagaaggtacttgtactaatcgttcctgtttgattacttttaaaccaggagccttcattccaggagttccagtgcagccagtcctcctcagatacccaaacaagctggatactgtgacctggacatggcaaggatatacattcattcagctttgtatgcttactttctgccagctcttcacaaaggtagaagttgagatgtttctgttcttttgggaaggaagcagcaagcattgtttaaaaatatcttccttcttttgcattttttctcttcgaagatttaaaagaagaattacacaaagaactagaactgcacatttgttaagattgtccttttaaaattattttctgttacaaggaaaaaataaaagattgattatagtgtcata

SEQ ID NO: 150330 - DNA, 5279 bp, Homo sapiens
  Payload ID: 9682
  Gene Symbol: LPCAT2
  Gene Name: lysophosphatidylcholine acyltransferase 2
  ENST ID: ENST00000615823
  CDS Start-End: 957-1715
gaaatacacaaaataactctttagcttgctctgagcatttttttcttttctgatagcaactttttaacgttgtggatccacagaacttactgctttgctttctcttttggggtcataattcctctccccttggagtgtccactccatgcatgtgcacttaggatgtgtggctgtgtgtgtgtttgggaaccctcacggacacataaggttctatgtcatcaagtagaaaacctatctcattatcattataatgtcttcagatgctttctaaggttcacctcttttttaacattagaagtcagtgaatgcagctttcattataatttttaatactttaaaatgtttttgtattagctgccagaatgctcagcagcaaagttatgactcacttctagcaagtgtggtagttcttgcttcaagcatttggtttcatgtagcttttcttcttattttttctttgtcttgattttatcattacttaaaacaattctgttgaatattaacacttggaaaatgaaaaaaagtggagaaataaatcaatgaataaacaaatattttaagtggcataggcacagcatttaatattttgcttcagtagttcttaattaaaaaaaaaaaatccctcattttggtaagcactagggatttaccaacatttagcaaatgatttctgttacacatactcttaaaatattcagtctatttatactatttattaattttctctttatcataaaacttttattcacataaaaacacattataaactttcaatgtggttgcaggagccttcattccaggagttccagtgcagccagtcctcctcagatacccaaacaagctggatactgtgacctggacatggcaaggatatacattcattcagctttgtatgcttactttctgccagctcttcacaaaggtagaagttgagtttatgccagttcaagtaccaaatgatgaagaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacaggaaccatgatggcagcattgacttccgagagtatgtgattggcctggctgtcttgtgcaacccttccaacacagaggagatcatccaggtggcatttaagctgtttgacgttgatgaggatggctacataacggaggaagagttctccaccattctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaagaagtccagacaaccccctccaccgccagtaataaagtcagccctgaaaagcatgaagagagtacctcagacaaaaaagatgactgaaagcagtatttccaataaggaaaacacagtagcttttgcttgaaattgtaaaggcacttattgataatacttttaatgtgttggtaatgatgtttaaaattgaaagatttttaaaacaaaaatgatagattttcttactaaaaatgtttttattaaccttgcttttattggaaaaaatcaagcaatatttcgttttcttttgtgttatattgtactttactgattcatttactggtgatacatatgtttttatggattttccagtttaatttgcatatacaaatgaatgcaatggtctattggtgagcattgagcaacactgtataaagttttaaaaatgtaaacactttttaatctactttcctctaaaaatcaataatattctattatttctaatccttttccacttgggaaataacaatgaagaatctgagaatttgacatctataactttacagattcatttttccatttaaatttcagtttcttggatcactgaatatgggaagggagagcttcactaattagacgcagcttcttaagaacttatattctctttgacatacatctctattgtagttttttgttttgttttgttttttgagatggagtcttgctctgtcacccaggctggagtgcagtggtgcaatctcagctcactgcaacctctgcctcctgggttcaagtgattctcgtacctcagactcccgagtagttgggattacaggtgcccaccaccacacccgactaatttttgtatttttagtagccatgtggttttgccatgttggccaggctggtttcgaactcctgacctcaggtgatccacccacctcagcctcccaaagtgctgggattacaggtgtgagccaccgttcccggcctattgtagattttcttaactacttgctaaggaaatcatatccttttacatgaactacaggtttagaacttggttttaagacaactgctatggccagaaggtaaatgggaattgccttattgaaggtaacattgattgcctaataagaaaatgaattgtttgccacagagttgaatttaatttgagttagatagttcagaatgtagcacttgccctataaatgaatcagatttgttctatttatataatattagaattaatatattatcatgtaagtgggaattttattttgttaagtggactctcaaattttagaacttgtgtgaaatatctcccagaaaacacaaaaggtttcaaggtatcacccaaagctagggaatcaacaaacgtactttattaatgcaagaccacaatttaagccccaggcaggaatccaacagtaacatttttcctttaggttaagcagtaatttttttgaattgtcatttttaatgggtctcacacatgcatattgctaatatcattcatgtttgaggttttcaacaaagaaccaatttattaatataatgtacaaaaatagttggttcattttctgaattcagtctttgaaataaaactccttgttttggccgtgtttctgaatgtattggtgattcacccccaagctaattttttaaagtcatttttgaagttgggaagtctcatgagagatgttgaagtatgtatttaatcaagagtcatgatttcaaactagttttacatattaagcagttagtgttctaatttaatgggtaaatgtgtgtttggataaatatctgaaaattttatccttaagtatatataattatttgcctcttatatgtcttaaagctatttaaacaaggtgttaaatgagccaaaacaattaagtaattagaacagtacatttttatcagagtgtctgtcatatgcaatgaatgtatgtaatactaaaaaatcatgactacttttatcaaagaaaaaccacacattaatcctattaatcatgaaagcgtagcattgtaaattaaaggttttctttgaggctcttgaaagtgatcccattgctttcctgttttaaaaatattttatgctctttatttccacttctgtgaatgtgatatttctattttgtgattatgttactgaataaacaaacttgctacataaaattcttagcaattaaaaaaattctgattctgccattttgtctcaaatgtaatatacccttttaatatcatatgtttacatatttatgaatgattaatcatttttgtttgcattaaactttatgaaatgtcagaaatgattttactctaatgaaactcaaattttgcccaaagtagcaatattcttaaagatgttgaattttgactggttgaattttatatagtaacacacaagtcgtgatcatcaatattattgcagaccaggactctgcttatatgccttgctaacaaagatttctttcacagaggcttttctcctctcaagacttaaagtaagaattacattttattaagtcagttaaatgcaccatggcttcatatagtaatataaaaaaactctttgaagtgagaaatattatatcctaaaacctctaaaccacaaacattcaattgaaagagttctgttgaaggataatgacatactgactgcttacagaccaagttgcttgcattttgtatgtttagccctcctttgccactgcttttagagccttggaaggctaagtgtgatagtaatgctagctctaatgcatatttaaaggagactgcctcgcttttagaagacatctggtctgctctctgcatgaggcacagcagtaaagctctttgattcccagaatcaagaactctccccttcagactattaccgaatgcaaggtggttaattgaaggccactaattgatgctcaaatagaaggatattgactatattggaacagatggagtctctactacaaaagtctttgggtatttgtttcttacatagaaaatgctaacatgaatagaaagatactggtgcaagaccattcccgggaaagtagacatacttacatttttttccttttctgctcatttgaatgaactcaattttatgttaaattgttatatcagagtgacaaataagtgctatggcttgatagaagtgaagctcttcacatatattcaaaatacatatcacaaactttggtaaataggatagtaatctgaagaacttttgccctttttaccccatttactgtaactcttgtttctaggtaatcgttctctctcaacaaacttctcaagcgtctgtgtaacaagccacatgttctaacaaattgtctccatcgcacttcaacagccaggtccctattttttataacgtattaaccttattattttcttattattttaaaagaatctatgcacattagcaaaatttaaaagatagagaaaaatataaacagaaaaaattatgtttacttctaccaccctaaatcaactattatcaattttatacatattttactccatcttttttcaaagtttcttacattttccaatgtcattaaaattctctgtgaatgtaaattttaaaaactgtacctactgttttttggaaatctgtaacaagctatgtgtaatcattcttctaatattaaacatattgtgtcc

SEQ ID NO: 150331 - DNA, 2268 bp, Homo sapiens
  Payload ID: 9683
  Gene Symbol: LPCAT3
  Gene Name: lysophosphatidylcholine acyltransferase 3
  Uniprot ID: Q6P1A2
  ENST ID: ENST00000261407
  CDS Start-End: 87-1550
ccggaattgggggtgaagcgatagcgttttgcccgcattcggggcgcgcggagctggggggtccctgtggggctcccggagttaagatggcgtcctcagcggagggggacgaggggactgtggtggcgctggcgggggttctgcagtcgggtttccaggagctgagccttaacaagttggcgacgtccctgggcgcgtcagaacaggcgctgcggctgatcatctccatcttcctgggttacccctttgctttgttttatcggcattaccttttctacaaggagacctacctcatccacctcttccatacctttacaggcctctcaattgcttattttaactttggaaaccagctctaccactccctgctgtgtattgtgcttcagttcctcatccttcgactaatgggccgcaccatcactgccgtcctcactaccttttgcttccagatggcctaccttctggctggatactattacactgccaccggcaactacgatatcaagtggacaatgccacattgtgttctgactttgaagctgattggtttggctgttgactactttgacggagggaaagatcagaattccttgtcctctgagcaacagaaatatgccatacgtggtgttccttccctgctggaagttgctggtttctcctacttctatggggccttcttggtagggccccagttctcaatgaatcactacatgaagctggtgcagggagagctgattgacataccaggaaagataccaaacagcatcattcctgctctcaagcgcctgagtctgggccttttctacctagtgggctacacactgctcagcccccacatcacagaagactatctcctcactgaagactatgacaaccaccccttctggttccgctgcatgtacatgctgatctggggcaagtttgtgctgtacaaatatgtcacctgttggctggtcacagaaggagtatgcattttgacgggcctgggcttcaatggctttgaagaaaagggcaaggcaaagtgggatgcctgtgccaacatgaaggtgtggctctttgaaacaaacccccgcttcactggcaccattgcctcattcaacatcaacaccaacgcctgggtggcccgctacatcttcaaacgactcaagttccttggaaataaagaactctctcagggtctctcgttgctattcctggccctctggcacggcctgcactcaggatacctggtctgcttccagatggaattcctcattgttattgtggaaagacaggctgccaggctcattcaagagagccccaccctgagcaagctggccgccattactgtcctccagcccttctactatttggtgcaacagaccatccactggctcttcatgggttactccatgactgccttctgcctcttcacgtgggacaaatggcttaaggtgtataaatccatctatttccttggccacatcttcttcctgagcctactattcatattgccttatattcacaaagcaatggtgccaaggaaagagaagttaaagaagatggaataatccatttccctggtggcctgtgcgggactggtgcagaaactactcgtctcccttttcacagcactcctttgccccagagcagagaatggaaaagccagggaggtggaagatcgatgcttccagctgtgcctctgctgccagccaagtcttcatttggggccaaaggggaaacttttttttggagaaggcgtcttgctttgtcacccacgctggaatgcagtggcgggatctcagctcaccgcaacctccacctcctgggttcaagtgattttcctgcctcagcctcccaagtagctgggaatacaggcacgccaccatgcccagctaatttttgtattttcagtagaaacgggatttcaccacgttggccaggctggtctcgaactcctgaccgcaagtgatccacccgcctccgcctcccaaagtgctgggattacaggcgtgagccaccgtgcccggcccaaaggggaaactcttgtgggaggagcagaggggctcacatctcccctctgattcccccatgcacattgccttatctctccccatctagccaggaatctattgtgtttttcttctgccaatttactatgattgtgtatgtgccgctaccaccaccccccccatgggggggtggagaggggtgcaaggccctgcctgctccactttttctaccttggaactgtattagataaaatcacttctgtttgttcagtttttc

SEQ ID NO: 150332 - DNA, 571 bp, Homo sapiens
  Payload ID: 9683
  Gene Symbol: LPCAT3
  Gene Name: lysophosphatidylcholine acyltransferase 3
  ENST ID: ENST00000538910
  CDS Start-End: 51-245
attcggggcgcgcggagctggggggtccctgtggggctcccggagttaagatggcgtcctcagcggagggggacgaggggactgtggtggcgctggcgggggttctgcagtcgggtttccaggagctgagccttaacaagttggcgacgtccctgggcgcgtcagaacaggcgctgcggctgatcatctccatcttcctgggaacaccttggatgaagcccctacccgcagaattctggcagtagcagcagaattttcaggttacccctttgctttgttttatcggcattaccttttctacaaggagacctacctcatccacctcttccatacctttacaggcctctcaattgcttattttaactttggaaaccagctctaccactccctgctgtgtattgtgcttcagttcctcatccttcgactaatgggccgcaccatcactgccgtcctcactaccttttgcttccagatggcctaccttctggctggatactattacactgccaccggcaactacgatatcaagtggacaatgccacattgtgttctgactttgaagctgattggt

SEQ ID NO: 150333 - DNA, 2902 bp, Homo sapiens
  Payload ID: 9683
  Gene Symbol: LPCAT3
  Gene Name: lysophosphatidylcholine acyltransferase 3
  ENST ID: ENST00000535479
  CDS Start-End: 54-1097
cgcattcggggcgcgcggagctggggggtccctgtggggctcccggagttaagatggcgtcctcagcggagggggacgaggggactgtggtggcgctggcgggggttctgcagtcgggtttccaggagctgagccttaacaagttggcgacgtccctgggcgcgtcagaacaggcgctgcggctgatcatctccatcttcctgggttacccctttgctttgttttatcggcattaccttttctacaaggagacctacctcatccacctcttccatacctttacaggcctctcaattgcttattttaactttggaaaccagctctaccactccctgctgtgtattgtgcttcagttcctcatccttcgactaatgggccgcaccatcactgccgtcctcactaccttttgcttccagatggcctaccttctggctggatactattacactgccaccggcaactacgatatcaagtggacaatgccacattgtgttctgactttgaagctgattggtttggctgttgactactttgacggagggaaagatcagaattccttgtcctctgagcaacagaaatatgccatacgtggtgttccttccctgctggaagttgctggtttctcctacttctatggggccttcttggtagggccccagttctcaatgaatcactacatgaagctggtgcagggagagctgattgacataccaggaaagataccaaacagcatcattcctgctctcaagcgcctgagtctgggccttttctacctagtgggctacacactgctcagcccccacatcacagaagactatctcctcactgaagactatgacaaccaccccttctggttccgctgcatgtacatgctgatctggggcaagtttgtgctgtacaaatatgtcacctgttggctggtcacagaaggagtatgcattttgacgggcctgggcttcaatggctttgaagaaaagggcaaggcaaagtgggatgcctgtgccaacatgaaggtgtggctctttgaaacaaacccccgcttcactggcaccattgcctcattcaacatcaacaccaacgcctgggtggcccggtgagctgctggtggggagcctggaccctggttccttccttccactgtcttcccagattggagggcaggggtgtaccatgtcacccctatgcgtctttcccatctgggcagaaccccctgtcgctcacactgactttgacccccacctatacccccctcccaaaaaaaccattactgtcatatttgaaaaaaaggcaagatataaaagtgcgttaagacctgggtgttactccagctctgccaatggacttatgtcctccactgccctgtttatcaacagctttacttgtttgtccccaccactagagtgtgggcagcttgagtagagtgtctggttcaccactgatctcagcatcagcctcagtcactgctgctgaaccaagtggctcgtgcgcacacggtctccagctccgccttgggtctgctttccatctctaaaagtaatcagtcagcactgcctcctgtaccctctgggggctacacgtgggaacccaccagcactccaatccaatcctcagggtgaggacccagaggcaggtggcgggatgcaaggaccagtcagtttgagggtcgccccacccacccttttctccagctacatcttcaaacgactcaagttccttggaaataaagaactctctcagggtctctcgttgctattcctggccctctggcacggcctgcactcaggatacctggtctgcttccagatggaattcctcattgttattgtggaaagacaggtaggcctccagggtgggggtgaaggggaatataagggacaagatgctgatgagctcctcctccctccccaggctgccaggctcattcaagagagccccaccctgagcaagctggccgccattactgtcctccagcccttctactatttggtgcaacagaccatccactggctcttcatgggttactccatgactgccttctgcctcttcacgtgggacaaatggcttaaggtgtataaatccatctatttccttggccacatcttcttcctgagcctactattcatattgccttatattcacaaagcaatggtgccaaggaaagagaagttaaagaagatggaataatccatttccctggtggcctgtgcgggactggtgcagaaactactcgtctcccttttcacagcactcctttgccccagagcagagaatggaaaagccagggaggtggaagatcgatgcttccagctgtgcctctgctgccagccaagtcttcatttggggccaaaggggaaacttttttttggagaaggcgtcttgctttgtcacccacgctggaatgcagtggcgggatctcagctcaccgcaacctccacctcctgggttcaagtgattttcctgcctcagcctcccaagtagctgggaatacaggcacgccaccatgcccagctaatttttgtattttcagtagaaacgggatttcaccacgttggccaggctggtctcgaactcctgaccgcaagtgatccacccgcctccgcctcccaaagtgctgggattacaggcgtgagccaccgtgcccggcccaaaggggaaactcttgtgggaggagcagaggggctcacatctcccctctgattcccccatgcacattgccttatctctccccatctagccaggaatctattgtgtttttcttctgccaatttactatgattgtgtatgtgccgctaccaccaccccccccatgggggggtggagaggggtgcaaggccctgcctgctccactttttctaccttggaactgtattagataaaatcacttctgtttgttcagtttttc

SEQ ID NO: 150334 - DNA, 1412 bp, Homo sapiens
  Payload ID: 9683
  Gene Symbol: LPCAT3
  Gene Name: lysophosphatidylcholine acyltransferase 3
  ENST ID: ENST00000536797
  CDS Start-End: 51-647
attcggggcgcgcggagctggggggtccctgtggggctcccggagttaagatggcgtcctcagcggagggggacgaggggactgtggtggcgctggcgggggttctgcagtcgggtttccaggagctgagccttaacaagttggcgacgtccctgggcgcgtcagaacaggcgctgcggctgatcatctccatcttcctgggttacccctttgctttgttttatcggcattaccttttctacaaggagacctacctcatccacctcttccatacctttacaggcctctcaattgcttattttaactttggaaaccagctctaccactccctgctgtgtattgtgcttcagttcctcatccttcgactaatgggccgcaccatcactgccgtcctcactaccttttgcttccagatggcctaccttctggctggatactattacactgccaccggcaactacgatatcaagtggacaatgccacattgtgttctgactttgaagctgattggtttggctgttgactactttgacggagggaaagatcagcatcattcctgctctcaagcgcctgagtctgggccttttctacctagtgggctacacactgctcagcccccacatcacagaagactatctcctcactgaagactatgacaaccaccccttctggttccgctgcatgtacatgctgatctggggcaagtttgtgctgtacaaatatgtcacctgttggctggtcacagaaggagtatgcattttgacgggcctgggcttcaatggctttgaagaaaagggcaaggcaaagtgggatgcctgtgccaacatgaaggtgtggctctttgaaacaaacccccgcttcactggcaccattgcctcattcaacatcaacaccaacgcctgggtggcccggtgagctgctggtggggagcctggaccctggttccttccttccactgtcttcccagattggagggcaggggtgtaccatgtcacccctatgcgtctttcccatctgggcagaaccccctgtcgctcacactgactttgacccccacctatacccccctcccaaaaaaaccattactgtcatatttgaaaaaaaggcaagatataaaagtgcgttaagacctgggtgttactccagctctgccaatggacttatgtcctccactgccctgtttatcaacagctttacttgtttgtccccaccactagagtgtgggcagcttgagtagagtgtctggttcaccactgatctcagcatcagcctcagtcactgctgctgaaccaagtggctcgtgcgcacacggtctccagctccgccttgggtctgctttccatctctaaaagtaatcagtcagcactgcctcctgtaccctctgggggctacacgtgggaacccaccagcac

SEQ ID NO: 150335 - DNA, 974 bp, Homo sapiens
  Payload ID: 9683
  Gene Symbol: LPCAT3
  Gene Name: lysophosphatidylcholine acyltransferase 3
  ENST ID: ENST00000540090
  CDS Start-End: 51-308
attcggggcgcgcggagctggggggtccctgtggggctcccggagttaagatggcgtcctcagcggagggggacgaggggactgtggtggcgctggcgggggttctgcagtcgggtttccaggagctgagccttaacaagttggcgacgtccctgggcgcgtcagaacaggcgctgcggctgatcatctccatcttcctgggcctaccttctggctggatactattacactgccaccggcaactacgatatcaagtggacaatgccacattgtgttctgactttgaagctgattggtttggctgttgactactttgacggagggaaagatcagaattccttgtcctctgagcaacagaaatatgccatacgtggtgttccttccctgctggaagttgctggtttctcctacttctatggggccttcttggtagggccccagttctcaatgaatcactacatgaagctggtgcagggagagctgattgacataccaggaaagataccaaacagcatcattcctgctctcaagcgcctgagtctgggccttttctacctagtgggctacacactgctcagcccccacatcacagaagactatctcctcactgaagactatgacaaccaccccttctggttccgctgcatgtacatgctgatctggggcaagtttgtgctgtacaaatatgtcacctgttggctggtcacagaaggagtatgcattttgacgggcctgggcttcaatggctttgaagaaaagggcaaggcaaagtgggatgcctgtgccaacatgaaggtgtggctctttgaaacaaacccccgcttcactggcaccattgcctcattcaacatcaacaccaacgcctgggtggcccgctacatcttcaaacgactcaagttccttggaaataaagaactctctcagggtctctcgttgctattcctggccctctggcacggcctgcactcaggata

SEQ ID NO: 150336 - DNA, 1099 bp, Homo sapiens
  Payload ID: 9683
  Gene Symbol: LPCAT3
  Gene Name: lysophosphatidylcholine acyltransferase 3
  ENST ID: ENST00000543794
  CDS Start-End: 51-527
attcggggcgcgcggagctggggggtccctgtggggctcccggagttaagatggcgtcctcagcggagggggacgaggggactgtggtggcgctggcgggggttctgcagtcgggtttccaggagctgagccttaacaagttggcgacgtccctgggcgcgtcagaacaggcgctgcggctgatcatctccatcttcctgggttacccctttgctttgttttatcggcattaccttttctacaaggagacctacctcatccacctcttccatacctttacaggcctctcaattgcttattttaactttggaaaccagctctaccactccctgctgtgtattgtgcttcagttcctcatccttcgactaatgggccgcaccatcactgccgtcctcactaccttttgcttccagatggcctaccttctggctggatactattacactgccaccggcaactacgatatcaagtggacaatgccacattgtgttctgactttgaagctgattgaattccttgtcctctgagcaacagaaatatgccatacgtggtgttccttccctgctggaagttgctggtttctcctacttctatggggccttcttggtagggccccagttctcaatgaatcactacatgaagctggtgcagggagagctgattgacataccaggaaagataccaaacagcatcattcctgctctcaagcgcctgagtctgggccttttctacctagtgggctacacactgctcagcccccacatcacagaagactatctcctcactgaagactatgacaaccaccccttctggttccgctgcatgtacatgctgatctggggcaagtttgtgctgtacaaatatgtcacctgttggctggtcacagaaggagtatgcattttgacgggcctgggcttcaatggctttgaagaaaagggcaaggcaaagtgggatgcctgtgccaacatgaaggtgtggctctttgaaacaaacccccgcttcactggcaccattgcctcattcaacatcaacaccaacgcctgggtggcccgctacatcttcaaacgactcaagttccttggaaataaagaactctctc

SEQ ID NO: 150337 - DNA, 2262 bp, Homo sapiens
  Payload ID: 9684
  Gene Symbol: LPCAT4
  Gene Name: lysophosphatidylcholine acyltransferase 4
  Uniprot ID: Q643R3
  ENST ID: ENST00000314891
  CDS Start-End: 179-1753
ggcgccctgacaacgcgggcgggctgggctgcgccgcctgctccccgcccctcggccgcctgcaccgggcggggcccgggccagagcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtccagtcatattgatgttaccattacttgggaaggaaagggatgaatggttgtaggacgcccgttggaaaatcacaaatgtttccaaggttcgtcctcttggccatagctggatgaatcttcctcttcggacagggctctttcctgcacagaaatcatactgaggttccatatcctccctcctgctgtcatctcctatatgtacattttaacagacttcctcgtgaacctcttttcagcccattccctcttgctctgtcctcattaaagattaaaaaatagcttgctaccattcc

SEQ ID NO: 150338 - DNA, 672 bp, Homo sapiens
  Payload ID: 9684
  Gene Symbol: LPCAT4
  Gene Name: lysophosphatidylcholine acyltransferase 4
  ENST ID: ENST00000567507
  CDS Start-End: 1-255
ttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggataccaagggtttggtggacttccgagatgtggcccttgcactagcagctctggatgggggcaggagcctggaagagctaactcgtctggcctttgagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcag

SEQ ID NO: 150339 - DNA, 1719 bp, Homo sapiens
  Payload ID: 9684
  Gene Symbol: LPCAT4
  Gene Name: lysophosphatidylcholine acyltransferase 4
  ENST ID: ENST00000617710
  CDS Start-End: 463-1518
cagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaagcgggccacctcaggaggcaagtggccgcagtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctatt

SEQ ID NO: 150340 - DNA, 2035 bp, Homo sapiens
  Payload ID: 9685
  Gene Symbol: LPGAT1
  Gene Name: lysophosphatidylglycerol acyltransferase 1
  Uniprot ID: Q92604
  ENST ID: ENST00000366996
  CDS Start-End: 817-1929
ggcgggggacacccgcccccgctctccgcagccgcccgccgtccgcgcccgccgaggtgagcccggcgcgcgggccgcgcccgccgccacgacccttccacatccgcggaaaccgctgcaggctccaccggctccccgcgctgcggtcgcctcttctctgcccctttcatcatcccctgcttccttgccctctggtcggaaatctcattctcttcatccccagttccttggcttttacctctttctggcttttgctcccttccccctactcctgtccttcctctttttcgcattataaccccctactttcttcctctcaccttgtaagctttttttctaggccccccattttttttcttaaaaaaaaaagggaaacaaaaaccctattgctacaaatgagaattttgagggtaactcttcgctagagccagagaccttttaaaggaatgcatcggtgtgcaggaatcgtggtggtgaggagactgaggtcctcagtatctgggaaatcttattgaggggaccctgtttcggtcatgtcacttgtgtcttcagtttggagatcctgaggttgtctgaagcgagtggatctatttttctaagtccaatagacgaccgcagtgagacacggtgcggggacggccaccgattactgaatgggaattgtgttatcatttgctaaatatattgtgacatacttcgtgcctcggtgaacagctcccttgaccttgtgcggctcctcctccctcgctctctgtccccctctggaatttcccctgagagatcaccgagaaagacaggacggagtccagtgtgagaatggctataactttggaagaagctccgtggctgggctggctcttggtgaaagcactgatgaggtttgccttcatggtcgtcaacaacctggttgctattccatcctacatctgctatgtaattatacttcagccccttcgagtgctggacagtaagcggttctggtatatcgaaggaatcatgtataaatggcttttaggaatggtagcttcctggggatggtatgctggatatacagtgatggaatggggagaagatattaaagcagtttcaaaagatgaagcagtgatgttggtgaatcatcaggcaacaggagatgtgtgcacactgatgatgtgcctccaggacaaaggactggttgttgctcagatgatgtggttgatggatcatatttttaagtacacaaactttggaattgtttctctagttcatggagacttctttataagacagggaagatcttatcgtgaccaacagctgctgcttctcaagaagcacttagaaaataattacaggagcagagatcgaaaatggattgttttgtttccagaagggggcttcctcaggaagaggcgagaaacaagtcaggcatttgccaagaaaaataacttgccatttcttacaaatgttactctgccaaggtctggggcaacaaaaattattttgaatgcacttgtagcacaacagaaaaatggaagtccagcaggaggagatgctaaagaattagacagcaaatcaaaaggcctccagtggataatagatacaacgatagcttatcccaaagctgaacctatagatattcaaacctggatccttggatacaggaaaccaacagtcacacatgtacattacaggatctttccaattaaagatgtacccctggagactgatgaccttaccacttggctctatcagcggtttgttgaaaaagaagacctcttatcacatttttatgaaacaggagcttttccaccttccaagggccataaggaagctgtttccagggagatgaccctcagcaacttgtggatatttctcatacagtcttttgcatttttgtcaggctatatgtggtacaacatcattcagtatttttaccattgcctgttttaggaattgacgtggacttgtcaaggtcaccgtaggagttcagactttctttcataagtgtgcattattttacatgtgcaaatcagaatatatttaaaaaaaagcaaaa

SEQ ID NO: 150341 - DNA, 7782 bp, Homo sapiens
  Payload ID: 9685
  Gene Symbol: LPGAT1
  Gene Name: lysophosphatidylglycerol acyltransferase 1
  Uniprot ID: Q92604
  ENST ID: ENST00000366997
  CDS Start-End: 228-1340
ctccccgccagtccgggcgaacgcggccgggcccttggggaccgagtctcggcgccgccggggaacgggcgcgggccgcgccacagccggagcggggcagggccccgccaccgccttcttccgccggccccgccgccggccatgcattcttccggctcctctgactcccaaagccccggctggggcccggccagcccgagaaagacaggacggagtccagtgtgagaatggctataactttggaagaagctccgtggctgggctggctcttggtgaaagcactgatgaggtttgccttcatggtcgtcaacaacctggttgctattccatcctacatctgctatgtaattatacttcagccccttcgagtgctggacagtaagcggttctggtatatcgaaggaatcatgtataaatggcttttaggaatggtagcttcctggggatggtatgctggatatacagtgatggaatggggagaagatattaaagcagtttcaaaagatgaagcagtgatgttggtgaatcatcaggcaacaggagatgtgtgcacactgatgatgtgcctccaggacaaaggactggttgttgctcagatgatgtggttgatggatcatatttttaagtacacaaactttggaattgtttctctagttcatggagacttctttataagacagggaagatcttatcgtgaccaacagctgctgcttctcaagaagcacttagaaaataattacaggagcagagatcgaaaatggattgttttgtttccagaagggggcttcctcaggaagaggcgagaaacaagtcaggcatttgccaagaaaaataacttgccatttcttacaaatgttactctgccaaggtctggggcaacaaaaattattttgaatgcacttgtagcacaacagaaaaatggaagtccagcaggaggagatgctaaagaattagacagcaaatcaaaaggcctccagtggataatagatacaacgatagcttatcccaaagctgaacctatagatattcaaacctggatccttggatacaggaaaccaacagtcacacatgtacattacaggatctttccaattaaagatgtacccctggagactgatgaccttaccacttggctctatcagcggtttgttgaaaaagaagacctcttatcacatttttatgaaacaggagcttttccaccttccaagggccataaggaagctgtttccagggagatgaccctcagcaacttgtggatatttctcatacagtcttttgcatttttgtcaggctatatgtggtacaacatcattcagtatttttaccattgcctgttttaggaattgacgtggacttgtcaaggtcaccgtaggagttcagactttctttcataagtgtgcattattttacatgtgcaaatcagaatatatttaaaaaaaagcaaaagaaattcaatggatggattaatatttatccccctttgggatattttaaaatctactaaaatgaggattagtaatataatgacctgctaatatattttaagaacatgttttaaaaagatacactctatcacatatttaagcaaacatcacatttggagaagaggaaatcataaaatcatcctagaagactatctgagagaaattctgttgccaccagttatacttgacaatttagttgaagctcagaaagttatattcatccctcttagctgtagtctatattagggcagttctctagaacgcccacatttccaccaactcagtaaacttgaggggagctggttggcacctcgtgaagaactctttccctgtcgtttgcagtaacaaactccagtctgttgcagtaacaaactccagtctgttgcagtaacaaactctagaatattgacattctctgtgggggaaaagcagtgtccactggaccccttctggtactggatgtgttctttacaaaggctagctcagtccaacactgtgtttacatacactcgtgcttttccttatctgacttctcattttgtatcagaggcatatcataaattgataattttgcaaaatgcacttttttgagatgcagatatagcaaaggattagtaatatagcctgaaaacaaatgggagcatagcagtgtgtgaggttctcgagaactgtcttgtctctgtgtgtttatttgcctgccagtgctctccagcgccatcctgccctggacaccaccctgacgtgatgcctctattgcagctcagaggctttattttttccattttgacattggcactaaatgcatttggggatggttaaaacaaattactatagaacatttaaatgatcagtttaaggggaaataggctagtttatagaaaaataagagctagtggcttataatggtgacaggttctcatgtggcacccctaggacctgtgcagacagtagtctgttgaatcattacatcaaggagctgcccctgtcagggtgagtgtaattaggaacgataccagcacataaggctccccccaatctcttccagttgctttttcttttttcttttttttttagacaggtcttactctgtcacccaggctgtagtgcagtggcataatctcagctcactgcagtctctgcctcccgggttcgagcgattctcctgcctcagcctcccgagtagctgggactacaggcacccaccatcatgcttggctaatttttgtatttttagtagagatggggtttcaccatgttggccaggctggcctcgaactcctgacctcaggtgatctgcccacctcggcttcctaaagtgctgggattgcaggcgtgagccaccacgcccggcctccagttgcttttgaagagggtaaagtcaagtttctatttctagaaaacattttttagaaatttgttgcgatgtttgtacaatttacctcataagagaaccacacccttctccaaaagtgctggtactgcatcagtgagatgagtagggtttttgtttgggattgtaagactattaagatcctagtaagtcagtggtagtttactgtgatgtgagcattgtagattcccccgttgtcactaatcacacaacaattttgagaagtaggctataaaacaaaaaaaggttgctgttttctatttttaaataaaccaaaaaaaaacagaaaagatgtgaattttccccagttatgtgggaaaggtaaagcaacaccaaataaaagcccacagcagcttcatctttacgataactcagtgcatatgtgaaagagaatgatgcattaactgaaatacctcattgaatattatactactactggtaaaatgcagaagacagtgttaatgtgtttggtttggggactggttgttataaaatgcaatttttttttaaatctaagcatttcattatgtgttctacagtgtcggtgaataaatgaaaccaatctcaatttagaggtatggatgatgacagaaagcccaatagaagcttaatgatgcttctgtttgaggcccagcaagcaccactaaattactggatgaaatgaaattgttcacttgagggattagtcaaccatctgggggagaagttgctcactgtcaaatacagcatgcacggtcctagctgatagaccttttcctcattgctacagcaagccacagggtagagtgaccagttctcctatccaaaaataaatgcgaacatgcatacataaatgtggctgagggccacttttgccatcactgtgctccaaaggaacatgatattgttaaatatactgtacacattaaactattctataagatgctttacttttcaagtacggtgtcattttcacagtctccagggtgacaaatgccaatagatatgtgagttaatttttttaaatatctccgtgagttgtaaatagatgtgtatttgatctgccctatccttctttgattctttaacatgttctctctcttctgtttgcaaaatatgtttgaaagcattggtagtgctttccttatcagtaactggagttctcctgcttgcactagagaaggtaaagagagaatcagtattcttatatggcaatctggggaagcagcaatatgccactgtacaaaactgaagaaaagttcctaatttgtactttgtgaagggagatgaaaggacgtttaaagtatatatattttgtcaagaggaaagaagataaaactatgccagttttatatcaatagcttgtagaagctcagctcttcttggtcttggctagactgcctagattcccacagcagacaaggttgagaatccattgctggaatcttggtattgatgagttacagtgatggaacatgtgcttggccacaggcaggtccagtcactgcaaaagtgaccaagccagcaggtcacccttaacttcagaaacaattattggtggtgaactgtacttaaattgcagagaaacctgtaagtaatggaaggtaaagaaaaattacagaatggaaaataatattttgggcaagcaaacaaattcactgagaattccaaaagtatattaaaaaagaagatagctatgagttcagatctatcttattggtctttaatattacaaccaatccttaactttccactataaaggaaggattactagattgattactttctggatagataatctggtaataaatgataggtaaatcaaaaattacttttatttaggagtttgaattcttactctcatcagacattttttttctagggacgcttactaattaaatgatttaagttgtttcttaggggttttttgcctatatatttatgactgtgttaatgagtagtgaaatgatgcggaaagacagctatcaggaagaggaaatacagaagcctgaataatctatgggttagaaaagcatccctgaataatcaaaaattggcagtattggcattgttctcaagcctttttatgaaaatgaaatctgaaatcaccaaatgtaaacctgggaacattattctagtgttgctgtcttggattcatgttaagaagcgtcttcattctttgctcatgttgcccacttcttgtggatttgtctgagtgttttttgacaatcacttccttaaagactcttctgaactagttggacctggttaatcatagagagtagcctttaatcatggatagtcttcttggattatttttatatttgaaaagaaaatgttttatttgcactactgagtaggaagagttaattgttttctttgttctttttttgaagtcattacacaggacttcactccagagttaccattatgagtgtgttcagctctggtccacagaggatggataaaaatggtttgttatgtttttttgctctgcagtgctatgagccttatatctgttaatatgaaggacaaagtcaaaagcagcagtggatagcaggaagggtagagactaatatgtttgggaccaaaaccatctaagttagagatttccagatcacagaggggctgggcattctctggagcagtcattggttggtgctttattgtaatcattttgcgccaatccccaacaattaggaactggaccctgggaataagctgagggtgctgaactgttggggaagggtgactgtagccacatggaagataaaatatgggtttttctgcaaaatttccatctgagggtttttacatttaatatttttttaagacagtttaaagagcaaacgttttttaagtgtattctagttgcaaagtatgcacacatatcttgaatggctttatttttattgtgtaaaactgttgaacacatgactgtgatgcacaaattctttacgtgtaaggagtctatgcattttacagtaacttattttatgatcgggtgatgagacagttatactttcaactgccattatttttattaagtgctttcattttctttacagttattataaaattgtatttattttatacagatgggttttcattttcctgatgctgtaatgtttacttcagcttgttgacctttctttgtgttatctgcatgttgtaacgtgtgataagaatgaatgtaaaggctgtggcaactgtaattaatttttgtaaagggctggtcacacgtggatctggtttatgaatgcatttgggatgattttggtaaccagatcaccttttcagaaatttagatgtgaacaccaaaagaagcattttctcaacaaaaattaatagctggttctattttttttaaacctagaaaaaataaagttgatttttttcaattaaagtgcttttaattcttagcagtggggatggggcatgtgtgttttaccagagctatttgggcattaatatctgcaggcaagtacttaaagcacactgtggcagttggatgctgaaggcaaactgaaaaaccaaatgaaaaaacatcagacttccttctttggtttaaaaatatttccccctttctccccattctcccaatccagtggtgtgctggtaaatgtttagcagttcactcttctgggagaaaattatgtattcaactatacatgtttgttataaattttgctgatagcaagaacatataacacaattaacaaataataagatacaaatactttattgtaaatcccatatagccagttgattctcacagtatacttagttgctcaggaaagaactaaaatgcttttttaaaaggatacttaattgctttttgctcaactcctacagtcaacctatgattgattgtctttcaactgtgatttgaaaaatggcagactgtccaaatctaactcatttcccaataaatttattatcattcaatctgatacgtgatctactgttaaaactgtttcttaccatggtacatattagactcattaagccgaaaccacttttagctttaacattaattgtaaatttatatgattcaattttcataaccaatgcttaacaactgcaggcaaaattctaaaatgtgaccactgggtcttgggaatcagtaggggctgtatccagcacaccactgccccatcctttttttcttaactattagtgttgaataaacttctcatagttaatctacttgctgaactcaggaaattcctatcactgaccctggccagggctttaaagggtaggaaaagcattaatgtcagtcctacacagcgaacttttgatttagaagaatgtgacagaaagaaaacatttactgaaatacatgggaagcttgcatatttctaaagttgtctttatacttttcatttctcaaagctaagtaaactgtggtataggcatctctaagatgttagcatttaaaacatcaattgttttattgatgtttaaacaattgtttaaatcccactgaaaaatttaaatattaaaatatcttgcacagtctaccaaatgagttaaatcgttacagtcgtgtctacctcttatttttctatctgtatttaggctgctgttttggtgagattctaatttctttttcccctggaactactttctgtggaagacaaggaacagactggggacagaggcctgaaaacaaattggaagcactcagagatctattgctgaccagccctattcctcatgagttggcggggggaaagccattgtttttaatttccacttaatatgaaaatgcttgtttttaaaatgttttttcctgctgaacaaatgtatttttaaaaggaaaaaaattctcttttggctctaagaagtcagctgtatgagcaggcgtgaccatatcataacatgctgatatgatagaaatcaataaatttttacctctcagga

SEQ ID NO: 150342 - DNA, 2585 bp, Homo sapiens
  Payload ID: 9686
  Gene Symbol: LYPLA1
  Gene Name: lysophospholipase I
  Uniprot ID: O75608
  ENST ID: ENST00000316963
  CDS Start-End: 195-887
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagtttgttttttctttattgtccttcatagcaggccaagtattgcctctctgcaatagacagctactgtcaatacatgctgtaatttgacattctgggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctgacttttctgtga

SEQ ID NO: 150343 - DNA, 1308 bp, Homo sapiens
  Payload ID: 9686
  Gene Symbol: LYPLA1
  Gene Name: lysophospholipase I
  Uniprot ID: O75608
  ENST ID: ENST00000343231
  CDS Start-End: 6-650
ggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaa

SEQ ID NO: 150344 - DNA, 250 bp, Homo sapiens
  Payload ID: 9686
  Gene Symbol: LYPLA1
  Gene Name: lysophospholipase I
  ENST ID: ENST00000522007
  CDS Start-End: 33-209
ccttccgcttgcgctgtgagctgaggcggtgtatgtgcggcaataacatgtcaaccccgctgcccgccatcgtgcccgccgcccggaaggccaccgctgcggtgattttcctgcatggattgggagatactggggtcctatcggtggtgctaatagagatatttctattctccagtgccacggggattgtgaccctttggttcccctgatgtttggttctcttacggtggaaaaactaaaaacattggtg

SEQ ID NO: 150345 - DNA, 580 bp, Homo sapiens
  Payload ID: 9686
  Gene Symbol: LYPLA1
  Gene Name: lysophospholipase I
  ENST ID: ENST00000521352
  CDS Start-End: 310-580
gcattgcggaggaagtgtggccccgggacccccgcgggccggcctagggcacggcgtcagcctctgcagcgtgtttctgcctggtgtgtgggtgagggaaacctaagtccgccaggaaatcgccttattgtcacctcgcactcttatcctcaatgaaagaagtttgaagattgagtgtcctacaaggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagg

SEQ ID NO: 150346 - DNA, 746 bp, Homo sapiens
  Payload ID: 9686
  Gene Symbol: LYPLA1
  Gene Name: lysophospholipase I
  ENST ID: ENST00000518546
  CDS Start-End: 155-746
gggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacagg

SEQ ID NO: 150347 - DNA, 344 bp, Homo sapiens
  Payload ID: 9686
  Gene Symbol: LYPLA1
  Gene Name: lysophospholipase I
  ENST ID: ENST00000521898
  CDS Start-End: 36-344
cttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatct

SEQ ID NO: 150348 - DNA, 2482 bp, Homo sapiens
  Payload ID: 9686
  Gene Symbol: LYPLA1
  Gene Name: lysophospholipase I
  ENST ID: ENST00000618914
  CDS Start-End: 195-785
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagtttgttttttctttattgtccttcatagcaggccaagtattgcctctctgcaatagacagctactgtcaatacatgctgtaatttgacattctgggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctgacttttctgtg

SEQ ID NO: 150349 - DNA, 2526 bp, Homo sapiens
  Payload ID: 9686
  Gene Symbol: LYPLA1
  Gene Name: lysophospholipase I
  ENST ID: ENST00000618741
  CDS Start-End: 329-829
cagtccccagctcctccctgcattgcggaggaagtgtggccccgggacccccgcgggccggcctagggcacggcgtcagcctctgcagcgtgtttctgcctggtgtgtgggtgagggaaacctaagtccgccaggaaatcgccttattgtcacctcgcactcttatcctcaatgaaagaagtttgaagattgagtgtcctacaaggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagtttgttttttctttattgtccttcatagcaggccaagtattgcctctctgcaatagacagctactgtcaatacatgctgtaatttgacattctgggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctgacttttctgtg

SEQ ID NO: 150350 - DNA, 1117 bp, Homo sapiens
  Payload ID: 9687
  Gene Symbol: LYPLA2
  Gene Name: lysophospholipase II
  ENST ID: ENST00000374501
  CDS Start-End: 78-572
ggcctcctcattcctcctgagcatgatgggccctctggctctctttccccaggcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggcccccccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgagggg

SEQ ID NO: 150351 - DNA, 1072 bp, Homo sapiens
  Payload ID: 9687
  Gene Symbol: LYPLA2
  Gene Name: lysophospholipase II
  ENST ID: ENST00000374502
  CDS Start-End: 57-599
aagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggtgaatgtccccactgacccccccgccctttgtgtctgcatcctcgtggcttggggactgctgcagcactagctttgccctgagtcctgtccggcctccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggtcagtggggggaccatttcccactcccacttctctgcctccagccaggtgcctctcgtgatcccctcttaatcccctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggc

SEQ ID NO: 150352 - DNA, 868 bp, Homo sapiens
  Payload ID: 9687
  Gene Symbol: LYPLA2
  Gene Name: lysophospholipase II
  ENST ID: ENST00000374503
  CDS Start-End: 75-623
gaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatcca

SEQ ID NO: 150353 - DNA, 907 bp, Homo sapiens
  Payload ID: 9687
  Gene Symbol: LYPLA2
  Gene Name: lysophospholipase II
  ENST ID: ENST00000374505
  CDS Start-End: 91-504
gagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacaggcggggccctgtccctctacacggccctcacctgcccccaccctctggctggcatcgtggcgttgagctgctggctgcctctgcaccgggccttcccccaggtgaatgtccccactgacccccccgccctttgtgtctgcatcctcgtggcttggggactgctgcagcactagctttgccctgagtcctgtccggcctccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggtcagtggggggaccatttcccactcccacttctctgcctccagccaggtgcctctcgtgatcccctcttaatcccctcaggagatggcagctgtgaaggaatttcttgagaagctgctgcctcctgtctaactagtcgctggcc

SEQ ID NO: 150354 - DNA, 1810 bp, Homo sapiens
  Payload ID: 9687
  Gene Symbol: LYPLA2
  Gene Name: lysophospholipase II
  Uniprot ID: O95372
  ENST ID: ENST00000374514
  CDS Start-End: 308-1003
gtctcgaatctacaaggtgggagcgggtgagaacccagcgactgcgcggctgaatgacagggagtagccccgccgcctccaacatggcagcttctatccagcgaagccgggtccccgcttccgggttccgtactgtcggccaggctacttccggcagcgcgatggctgggttcccgggactcgaacggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggcccccccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 150355 - DNA, 429 bp, Homo sapiens
  Payload ID: 9687
  Gene Symbol: LYPLA2
  Gene Name: lysophospholipase II
  ENST ID: ENST00000421070
  CDS Start-End: 158-429
tttgcagtcagtggcagcagcagcaggacagaacctgggtgctgtgtggggctgatggcctggtggcctcttgggccaggagtgtgtcctgtgcctggttttgctcttgaccgccgccccgatgtatgcaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctgg

SEQ ID NO: 150356 - DNA, 614 bp, Homo sapiens
  Payload ID: 9687
  Gene Symbol: LYPLA2
  Gene Name: lysophospholipase II
  ENST ID: ENST00000420982
  CDS Start-End: 128-614
gagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccc

SEQ ID NO: 150357 - DNA, 1819 bp, Homo sapiens
  Payload ID: 9688
  Gene Symbol: LYPLAL1
  Gene Name: lysophospholipase-like 1
  Uniprot ID: Q5VWZ2
  ENST ID: ENST00000366927
  CDS Start-End: 17-682
ggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggttttaaatcaagatttaacattccaacacataaaaattatttatccaacagctcctcccagatttaaaataaccaatgactgcccagaacaccttgaatcaattgatgtcatgtgtcaagtgcttactgatttgattgatgaagaagtaaaaagtggcatcaagaagaacaggatattaataggaggattctctatgggaggatgcatggcaatacatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataagttgcttccagtgtgaggctgttttaaataaagctgctatgaatattcatgtaaga

SEQ ID NO: 150358 - DNA, 1898 bp, Homo sapiens
  Payload ID: 9688
  Gene Symbol: LYPLAL1
  Gene Name: lysophospholipase-like 1
  Uniprot ID: Q5VWZ2
  ENST ID: ENST00000366928
  CDS Start-End: 48-761
cgcggcaacgcaggggcggaaccgcatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggttttaaatcaagatttaacattccaacacataaaaattatttatccaacagctcctcccagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaataggaggattctctatgggaggatgcatggcaatacatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataagttgcttccagtgtgaggctgttttaaataaagctgctatgaatattcatgtaaga

SEQ ID NO: 150359 - DNA, 1765 bp, Homo sapiens
  Payload ID: 9689
  Gene Symbol: LAPTM4A
  Gene Name: lysosomal protein transmembrane 4 alpha
  Uniprot ID: Q15012
  ENST ID: ENST00000175091
  CDS Start-End: 509-1210
atccagtacgtggcacacattgctcagaaaagccccttgtgcccgctttctgccatccgcgctgtctcgtgtctccctttttccattaaatgcctcttttcttgcgggtctcatctcgggaatagtgcactacggggacatacctatccccaactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactta

SEQ ID NO: 150360 - DNA, 3173 bp, Homo sapiens
  Payload ID: 9690
  Gene Symbol: LAPTM4B
  Gene Name: lysosomal protein transmembrane 4 beta
  Uniprot ID: Q86VI4
  ENST ID: ENST00000445593
  CDS Start-End: 681-1634
atcctattttctgggaaaagattactaccacagtaattgagctgtgaagcggagacaaattgctctcggtggtggttcaaagtactgcaattgactggaatagcaccgcgcagttttccttcctctcgtgcaagataagagtgataggagctgtatcgattacctgcaagatagaagtagaagcgggccgggtgcggtggctcacgcctgtaatcccagcactttgggaggctgaggcgggtggatcattcgacgtcaggagttccagaccagcctgaccaacatggtgaaaccccgtctctactaaaaatacaacaaattagccgggtgtggtggcaagcgcctgtaatcccagctactcggttggttgggcaggagaatcgcttgaacccgggaggcggaggttgcagtgagccgagatcgcgccattgcactccagcctgggcgacaagagcgagactctgtctcaaaaaaaaaaaaaaaagaagtagaagggaagaaaatcgcaaggaactagactaaaagaatctcgacccttgaatggagttacacgaacggccagatgaaagaaggaaggcccggacctccactcagggccgactaggggactggcggagggtgcacgctgatggatttactcaccgggtgcttggagctccagcagctggctggagcccgcgatgacgtcacggactcgggtcacatggccaagtccgccccgccccctccccgtccccgccgctgcagcggtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctggaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccacatccaagatgaccttgtgattttgtgctgattgtgtctgaggacctttccctccacatatggtctggcagatgcacccagttcagcctaaggagtaggcttttttttgggggggggaggtcgggtgggggggatttttaatcttttaattttcaagatggttaaaatattgaaatgtttaagtggataactatattattcataaaatgactgagtgaaaactaatacactatgagatgaaaagtacttgtcagggattttcaagcttttgctcaagtaattactatgaaataacaatttctagaaatgaagaacaatccgtggagaataaattaccattggtgtgggggaaaaaagccaaacagaagtagaaaaaggtgtagccggcatacaaatgttatctacagtgtatttttagat

SEQ ID NO: 150361 - DNA, 915 bp, Homo sapiens
  Payload ID: 9690
  Gene Symbol: LAPTM4B
  Gene Name: lysosomal protein transmembrane 4 beta
  Uniprot ID: Q86VI4
  ENST ID: ENST00000521545
  CDS Start-End: 235-915
cgccccctccccgtccccgccgctgcagcggtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaa

SEQ ID NO: 150362 - DNA, 618 bp, Homo sapiens
  Payload ID: 9690
  Gene Symbol: LAPTM4B
  Gene Name: lysosomal protein transmembrane 4 beta
  ENST ID: ENST00000517924
  CDS Start-End: 162-618
gctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaaaattctttttaatctttcggcagacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatg

SEQ ID NO: 150363 - DNA, 2758 bp, Homo sapiens
  Payload ID: 9690
  Gene Symbol: LAPTM4B
  Gene Name: lysosomal protein transmembrane 4 beta
  Uniprot ID: Q86VI4
  ENST ID: ENST00000619747
  CDS Start-End: 681-1634
atcctattttctgggaaaagattactaccacagtaattgagctgtgaagcggagacaaattgctctcggtggtggttcaaagtactgcaattgactggaatagcaccgcgcagttttccttcctctcgtgcaagataagagtgataggagctgtatcgattacctgcaagatagaagtagaagcgggccgggtgcggtggctcacgcctgtaatcccagcactttgggaggctgaggcgggtggatcattcgacgtcaggagttccagaccagcctgaccaacatggtgaaaccccgtctctactaaaaatacaacaaattagccgggtgtggtggcaagcgcctgtaatcccagctactcggttggttgggcaggagaatcgcttgaacccgggaggcggaggttgcagtgagccgagatcgcgccattgcactccagcctgggcgacaagagcgagactctgtctcaaaaaaaaaaaaaaaagaagtagaagggaagaaaatcgcaaggaactagactaaaagaatctcgacccttgaatggagttacacgaacggccagatgaaagaaggaaggcccggacctccactcagggccgactaggggactggcggagggtgcacgctgatggatttactcaccgggtgcttggagctccagcagctggctggagcccgcgatgacgtcacggactcgggtcacatggccaagtccgccccgccccctccccgtccccgccgctgcagcggtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctggaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccacatcc

SEQ ID NO: 150364 - DNA, 2223 bp, Homo sapiens
  Payload ID: 9691
  Gene Symbol: LAPTM5
  Gene Name: lysosomal protein transmembrane 5
  Uniprot ID: Q13571
  ENST ID: ENST00000294507
  CDS Start-End: 76-864
cttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcagtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcataacagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttc

SEQ ID NO: 150365 - DNA, 13480 bp, Homo sapiens
  Payload ID: 9692
  Gene Symbol: LYST
  Gene Name: lysosomal trafficking regulator
  Uniprot ID: Q99698
  ENST ID: ENST00000389793
  CDS Start-End: 176-11581
gcggcggcggcagcggcgtcggctcggggttctccgggagagggggagtgcgcggcggccgcagctgccacaaaccaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgaagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacagagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaagacccttcttgaaggatgctgtggtgaagatattatttatatgaatgagaatggagagtttaagttggatgtagactctaatgctataatccaagatgttaagctgttagaggaactattgcttgactggaagatatggagtaaagcagagcaaggtgtttgggaaactttgctagcagctctagaagtcctcatcagagcagatcaccaccagcagatgtttaatattaagcagttattgaaagctcaagtggttcatcactttctactgacttgtcaggttttgcaggaatacaaagaggggcaactcacacccatgccccgagaggtttgtagatcatttgtgaaaattatagcagaagtccttggatctcctccagatttggaattattgacaattatcttcaatttccttttagcagttcaccctcctactaatacttacgtttgtcacaatcccacgaacttctacttttctttgcacatagatggcaagatctttcaggagaaagtgcggtcaatcatgtacctgaggcattccagcagtggaggaaggtcccttatgagccctggatttatggtaataagcccatctggttttactgcttcaccatatgaaggagagaattcctctaatattattccacaacagatggccgcccatatgctgcgttctagaagcctaccagcattccctacttcttcactactaacgcaatcacaaaaactgactggaagtttgggttgtagtatcgacaggttacaaaatattgcagatacttatgttgccacccaatcaaagaaacaaaattctttggggagttccgacacactgaaaaaaggcaaagaggacgcattcatcagtagctgtgagtctgcaaaaactgtttgtgaaatggaagctgtcctctcagcccaggtctctgtcagtgatgtcccaaagggagtgctgggatttccagtggtcaaagcagatcataaacagttgggagcagaacccaggtcagaagatgacagtcctggggatgagtcctgcccacgccgacctgattacctaaagggattggcctccttccagcgaagccacagcactattgcaagccttgggctagcttttccttcacagaacggatctgcagctgttggccgttggccaagtcttgttgatagaaacactgatgattgggaaaactttgcctattctcttggttatgagccaaattacaaccgaactgcaagtgctcacagtgtaactgaagactgtttggtacctatatgctgtggattatatgaactcctaagtggggttcttcttatcctgcctgatgttttgcttgaagatgtgatggacaagcttattcaagcagatacacttttggtcctcgttaaccacccatcaccagctatacaacaaggtgttattaaactattagatgcatattttgctagagcatctaaggaacaaaaagataaatttctgaagaatcgtggattttccttgctagccaaccagttgtatcttcatcgaggaactcaagaattgttagaatgcttcatcgaaatgttctttggtcgacatattggccttgatgaagaatttgatctggaagatgtgagaaacatgggattgtttcagaagtggtctgtcattcctattctgggactaatagagacctctctatatgacaacatactcttgcataatgctcttttacttcttctccaaattttaaattcttgttctaaggtagcagatatgttgctggataatggtctactctatgtgttatgtaatacagtagcagccctgaatggattagaaaagaacattcccatgagtgaatataaattgcttgcttgtgatatacagcaacttttcatagcagttacaattcatgcttgcagttcctcaggctcacaatattttagggttattgaagaccttattgtaatgcttggatatcttcaaaatagcaaaaacaagaggacacaaaatatggctgttgcactacagcttagagttctccaggctgctatggaatttataaggaccaccgcaaatcatgactctgaaaacctcacagattcactccagtcaccttctgctccccatcatgcagtagttcaaaagcggaaaagcattgctggtcctcgaaaatttccccttgctcaaactgaatcgcttctgatgaaaatgcgttcagtggcaaatgatgagcttcatgtgatgatgcaacggagaatgagccaagagaaccctagccaagcaactgaaacggaacttgcgcagagactacagaggctcactgttttagcagtcaacaggattatttatcaagaatttaattcagacattattgacattttgagaactccagaaaatgtaactcaaagcaagacctcagttttccagaccgaaatttctgaggaaaatattcatcatgaacagtcttctgttttcaatccatttcagaaagaaatttttacatatctggtagaaggattcaaagtatctattggttcaagtaaagccagtggttccaagcagcaatggactaaaattctgtggtcttgtaaggagaccttccgaatgcagcttgggagactactagtgcatattttgtcgccagcccacgctgcacaagagagaaagcaaatttttgaaatagttcatgaaccaaatcatcaggaaatactacgagactgtctcagcccatccctacaacatggagccaagttagttttgtatttgtcagagttgatacataatcaccaaggtgaattgactgaagaagagctaggcacagcagaactgcttatgaatgctttgaagttatgtggtcacaagtgcatccctcccagtgcatcaacaaaagcagaccttattaaaatgatcaaagaggaacaaaagaaatatgaaactgaagaaggagtgaataaagctgcttggcagaaaacagttaacaataatcaacaaagtctctttcagcgtctggattcaaaatcaaaggatatatctaaaatagctgcagatatcacccaggcagtgtctctctcccaaggaaatgagagaaaaaaggtgatccagcatattagaggaatgtataaagtagatttgagtgccagcagacattggcaggaacttattcagcagctgacacatgatagagcagtatggtatgaccccatctactatccaacctcatggcagttggatccaacagaagggccaaatcgagagaggagacgtttacagagatgttatttaactattccaaataagtatctccttagggatagacagaaatcagaagatgttgtcaaaccaccactctcttacctgtttgaagacaaaactcattcttctttctcttctactgtcaaagacaaagctgcaagtgaatctataagagtgaatcgaagatgcatcagtgttgcaccatctagagagacagctggtgaattgttactaggtaaatgtggaatgtattttgtggaagataatgcttctgatacagttgaaagttcgagccttcagggagagttggaaccagcatcattttcctggacatatgaagaaattaaagaagttcacaagcgttggtggcaattgagagataatgctgtagaaatctttctaacaaatggcagaacactcctgttggcatttgataacaccaaggttcgtgatgatgtataccacaatatactcacaaataacctccctaatcttctggaatatggtaacatcaccgctctgacaaatttatggtatactgggcaaattactaattttgaatatttgactcacttaaacaaacatgctggccgatccttcaatgatctcatgcagtatcctgtgttcccatttatacttgctgactacgttagtgagacacttgacctcaatgatctgttgatatacagaaatctctctaaacctatagctgttcagtataaagaaaaagaagatcgttatgtggacacatacaagtacttggaggaagagtaccgcaaaggagccagagaagatgaccccatgcctcccgtgcagccctatcactatggctcccactattccaatagcggcactgtgcttcacttcctggtcaggatgcctcctttcactaaaatgtttttagcctatcaagatcaaagttttgacattccagacagaacttttcattctacaaatacaacttggcgactctcatcttttgaatctatgactgatgtgaaagaacttatcccagagtttttctatcttccagagttcctagttaaccgtgaaggttttgattttggtgtgcgtcagaatggtgaacgggttaatcacgtcaaccttcccccttgggcgcgtaatgatcctcgtctttttatcctcatccatcggcaggctctagagtctgactacgtgtcgcagaacatctgtcagtggattgacttggtgtttgggtataagcaaaaggggaaggcttctgttcaagcgatcaatgtttttcatcctgctacatattttggaatggatgtctctgcagttgaagatccagttcagagacgagcgctagaaaccatgataaaaacctacgggcagactccccgtcagctgttccacatggcccatgtgagcagacctggagccaagctcaatattgaaggagagcttccagctgctgtggggttgctagtgcagtttgctttcagggagacccgagaacaggtcaaagaaatcacctatccgagtcctttgtcatggataaaaggcttgaaatggggggaatacgtgggttcccccagtgctccagtacctgtggtctgcttcagccagccccacggagaaagatttggctctctccaggctctgcccaccagagcaatctgtggtttgtcacggaatttctgtcttctgatgacatatagcaaggaacaaggtgtgagaagcatgaacagtacggacattcagtggtcagccatcctgagctggggatatgctgataatattttaaggttgaagagtaaacaaagtgagcctccagtaaactttattcaaagttcacaacagtaccaggtgactagttgtgcttgggtgcctgacagttgccagctgtttactggaagcaaatgcggtgtcatcacagcctacacaaacagatttacaagcagcacgccatcagaaatagaaatggagactcaaatacatctctatggtcacacagaagagataaccagcttatttgtttgcaaaccatacagtatactgataagtgtgagcagagacggaacctgcatcatatgggatttaaacaggttatgctatgtacaaagtctggcgggacacaaaagccctgtcacagctgtctctgccagtgaaacctcaggtgatattgctactgtgtgtgattcagctggcggaggcagtgacctcagactctggacggtgaacggggatctcgttggacatgtccactgcagggagatcatctgttccgtggctttctccaaccagcctgagggagtatctatcaatgtaatcgctgggggattagaaaatggaattgtaaggttatggagcacatgggacttaaagcctgtgagagaaattacatttcccaaatcaaataagcccatcatcagccttacattttcttgtgatggccaccatttgtacacagcaaacagtgatgggaccgtgattgcctggtgtcggaaggaccagcagcgcttgaaacagccaatgttctattccttccttagcagctatgcagccgggtgaatgcgaatgaacttcacgttctccaaagcactttaactccaaactagatttgttgacttcaccagttttaggaggttgaacctaaagaaatggatgactggacaaaccatccaaataatgataaagtctattcatctgcacaaaattctgaagagtcacatgatcctaagaggaaagttctgttctattttagtgataatctggaagattgtgtcaatatgcactagccaacaagttttaagcctcgcatggtacattaaaatgatattcttaaaattttttcccaccaaggtattccaaagaaaatattaaggtctcccctttttctatgattccaaaaggaccagtagaatttaaattggttggttgattgtttatataaaacacactaaaattatattttaaaagtttactgccatgaaatactcctcccaccacacacacatgctccaaaagaggaaagaaaaaaagataatttttaggacttgataattgctttctttgagaagcaaattattcagtaggtgcctctgtaccaaatattttatggaatatctaaatactaaaataaactatgaatgaatctcaaaattaggcagtttttgccagttgctttcttagctcaaaggagaaccagaatttttttgacagccacaaacaagaatacaggtatcttggatttcagacacattctgtttcttcataaaaattttacttaaaatctgtaacgctagatattgactatccttagttgagtcactgaggtttaaacacaatggtaagtcttaaagtctgctatttacagagcattgaatctgtaccaatttgcaatagaaagccttcagtatgcaagaagtttgcatgggtattaagaacacagcctaaataaggcatttgatctaatctgcaggaagaattttcttccccaaaacagaattataaaagcttactttaaacaggaggcagaataattcttttaggaaaccatttcattctgtttctactaacctataccatctgagaattctaggaagaataataaaatctcgtgtattccacagcaaacttacataccataaagacagaattcctaaacatcttggagccgtctgtctctcccatatgatggctgtctgtatatttttacttggggtgctgctttattggctttgaaaacactgtcagataagctcagtaatatgttaccatgggataaaaatatgtatccctgcctaagaataacttgtgcatttgttatggaaatttaattcatatggtgtttacagtactacttttgtaacttccagactttctaaaacattctgcttaaaaaccatataaaatataattccaaagtctctgctgtcaagatagattcgagagaaagcacgtggccatgtatgctttaaccttaaactgcatacacatgtagtgatacctaggctgcatttagatcaccgtgtgctcaggccaggtgtgaatcctgaggtccatggaggtgcagagatgagattactcctattcacgttgaagtgatttgctttgttaacaaaaaattgcagctattgtctagctttcatttttttactgagaactttaaattagtcccctattagaatagggttgctactcatctttttttaaaaaccgaatttcatcatttatctaaagagaaaatatgcagaataactggtcttgttaagagtgcaatattatatttttatgtaaaaataaaaattaatttggggggattatttattcagcatgaaacctaatatgtatatgtttgaaatacttcataatgtgcatgttgtagcaaacatttctgtaaattatcacaagctctgttacctttatatacactgcctcttcaatttggaaataaatttcataaaaata

SEQ ID NO: 150366 - DNA, 12985 bp, Homo sapiens
  Payload ID: 9692
  Gene Symbol: LYST
  Gene Name: lysosomal trafficking regulator
  ENST ID: ENST00000389794
  CDS Start-End: 180-4328
cgcggcggcggcggcagcggcgtcggctcggggttctccgggagagggggagtgcgcggcggccgcagctgccacaaaccaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgaagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaagacccttcttgaaggatgctgtggtgaagatattatttatatgaatgagaatggagagtttaagttggatgtagactctaatgctataatccaagatgttaagctgttagaggaactattgcttgactggaagatatggagtaaagcagagcaaggtgtttgggaaactttgctagcagctctagaagtcctcatcagagcagatcaccaccagcagatgtttaatattaagcagttattgaaagctcaagtggttcatcactttctactgacttgtcaggttttgcaggaatacaaagaggggcaactcacacccatgccccgagaggtttgtagatcatttgtgaaaattatagcagaagtccttggatctcctccagatttggaattattgacaattatcttcaatttccttttagcagttcaccctcctactaatacttacgtttgtcacaatcccacgaacttctacttttctttgcacatagatggcaagatctttcaggagaaagtgcggtcaatcatgtacctgaggcattccagcagtggaggaaggtcccttatgagccctggatttatggtaataagcccatctggttttactgcttcaccatatgaaggagagaattcctctaatattattccacaacagatggccgcccatatgctgcgttctagaagcctaccagcattccctacttcttcactactaacgcaatcacaaaaactgactggaagtttgggttgtagtatcgacaggttacaaaatattgcagatacttatgttgccacccaatcaaagaaacaaaattctttggggagttccgacacactgaaaaaaggcaaagaggacgcattcatcagtagctgtgagtctgcaaaaactgtttgtgaaatggaagctgtcctctcagcccaggtctctgtcagtgatgtcccaaagggagtgctgggatttccagtggtcaaagcagatcataaacagttgggagcagaacccaggtcagaagatgacagtcctggggatgagtcctgcccacgccgacctgattacctaaagggattggcctccttccagcgaagccacagcactattgcaagccttgggctagcttttccttcacagaacggatctgcagctgttggccgttggccaagtcttgttgatagaaacactgatgattgggaaaactttgcctattctcttggttatgagccaaattacaaccgaactgcaagtgctcacagtgtaactgaagactgtttggtacctatatgctgtggattatatgaactcctaagtggggttcttcttatcctgcctgatgttttgcttgaagatgtgatggacaagcttattcaagcagatacacttttggtcctcgttaaccacccatcaccagctatacaacaaggtgttattaaactattagatgcatattttgctagagcatctaaggaacaaaaagataaatttctgaagaatcgtggattttccttgctagccaaccagttgtatcttcatcgaggaactcaagaattgttagaatgcttcatcgaaatgttctttggtcgacatattggccttgatgaagaatttgatctggaagatgtgagaaacatgggattgtttcagaagtggtctgtcattcctattctgggactaatagagacctctctatatgacaacatactcttgcataatgctcttttacttcttctccaaattttaaattcttgttctaaggtagcagatatgttgctggataatggtctactctatgtgttatgtaatacagtagcagccctgaatggattagaaaagaacattcccatgagtgaatataaattgcttgcttgtgatatacagcaacttttcatagcagttacaattcatgcttgcagttcctcaggctcacaatattttagggttattgaagaccttattgtaatgcttggatatcttcaaaatagcaaaaacaagaggacacaaaatatggctgttgcactacagcttagagttctccaggctgctatggaatttataaggaccaccgcaaatcatgactctgaaaacctcacagattcactccagtcaccttctgctccccatcatgcagtagttcaaaagcggaaaagcattgctggtcctcgaaaatttccccttgctcaaactgaatcgcttctgatgaaaatgcgttcagtggcaaatgatgagcttcatgtgatgatgcaacggagaatgagccaagagaaccctagccaagcaactgaaacggaacttgcgcagagactacagaggctcactgttttagcagtcaacaggattatttatcaagaatttaattcagacattattgacattttgagaactccagaaaatgtaactcaaagcaagacctcagttttccagaccgaaatttctgaggaaaatattcatcatgaacagtcttctgttttcaatccatttcagaaagaaatttttacatatctggtagaaggattcaaagtatctattggttcaagtaaagccagtggttccaagcagcaatggactaaaattctgtggtcttgtaaggagaccttccgaatgcagcttgggagactactagtgcatattttgtcgccagcccacgctgcacaagagagaaagcaaatttttgaaatagttcatgaaccaaatcatcaggaaatactacgagactgtctcagcccatccctacaacatggagccaagttagttttgtatttgtcagagttgatacataatcaccaaggtgaattgactgaagaagagctaggcacagcagaactgcttatgaatgctttgaagttatgtggtcacaagtgcatccctcccagtgcatcaacaaaagcagaccttattaaaatgatcaaagaggaacaaaagaaatatgaaactgaagaaggagtgaataaagctgcttggcagaaaacagttaacaataatcaacaaagtctctttcagcgtctggattcaaaatcaaaggatatatctaaaatagctgcagatatcacccaggcagtgtctctctcccaaggaaatgagagaaaaaaggtgatccagcatattagaggaatgtataaagtagatttgagtgccagcagacattggcaggaacttattcagcagctgacacatgatagagcagtatggtatgaccccatctactatccaacctcatggcagttggatccaacagaagggccaaatcgagagaggagacgtttacagagatgttatttaactattccaaataagtatctccttagggatagacagaaatcagaagatgttgtcaaaccaccactctcttacctgtttgaagacaaaactcattcttctttctcttctactgtcaaagacaaagctgcaagtgaatctataagagtgaatcgaagatgcatcagtgttgcaccatctagagagacagctggtgaattgttactaggtaaatgtggaatgtattttgtggaagataatgcttctgatacagttgaaagttcgagccttcagggagagttggaaccagcatcattttcctggacatatgaagaaattaaagaagttcacaagcgttggtggcaattgagagataatgctgtagaaatctttctaacaaatggcagaacactcctgttggcatttgataacaccaaggttcgtgatgatgtataccacaatatactcacaaataacctccctaatcttctggaatatggtaacatcaccgctctgacaaatttatggtatactgggcaaattactaattttgaatatttgactcacttaaacaaacatgctggccgatccttcaatgatctcatgcagtatcctgtgttcccatttatacttgctgactacgttagtgagacacttgacctcaatgatctgttgatatacagaaatctctctaaacctatagctgttcagtataaagaaaaagaagatcgttatgtggacacatacaagtacttggaggaagagtaccgcaaaggagccagagaagatgaccccatgcctcccgtgcagccctatcactatggctcccactattccaatagcggcactgtgcttcacttcctggtcaggatgcctcctttcactaaaatgtttttagcctatcaagatcaaagttttgacattccagacagaacttttcattctacaaatacaacttggcgactctcatcttttgaatctatgactgatgtgaaagaacttatcccagagtttttctatcttccagagttcctagttaaccgtgaaggttttgattttggtgtgcgtcagaatggtgaacgggttaatcacgtcaaccttcccccttgggcgcgtaatgatcctcgtctttttatcctcatccatcggcaggctctagagtctgactacgtgtcgcagaacatctgtcagtggattgacttggtgtttgggtataagcaaaaggggaaggcttctgttcaagcgatcaatgtttttcatcctgctacatattttggaatggatgtctctgcagttgaagatccagttcagagacgagcgctagaaaccatgataaaaacctacgggcagactccccgtcagctgttccacatggcccatgtgagcagacctggagccaagctcaatattgaaggagagcttccagctgctgtggggttgctagtgcagtttgctttcagggagacccgagaacaggtcaaagaaatcacctatccgagtcctttgtcatggataaaaggcttgaaatggggggaatacgtgggttcccccagtgctccagtacctgtggtctgcttcagccagccccacggagaaagatttggctctctccaggctctgcccaccagagcaatctgtggtttgtcacggaatttctgtcttctgatgacatatagcaaggaacaaggtgtgagaagcatgaacagtacggacattcagtggtcagccatcctgagctggggatatgctgataatattttaaggttgaagagtaaacaaagtgagcctccagtaaactttattcaaagttcacaacagtaccaggtgactagttgtgcttgggtgcctgacagttgccagctgtttactggaagcaaatgcggtgtcatcacagcctacacaaacagatttacaagcagcacgccatcagaaatagaaatggagactcaaatacatctctatggtcacacagaagagataaccagcttatttgtttgcaaaccatacagtatactgataagtgtgagcagagacggaacctgcatcatatgggatttaaacaggttatgctatgtacaaagtctggcgggacacaaaagccctgtcacagctgtctctgccagtgaaacctcaggtgatattgctactgtgtgtgattcagctggcggaggcagtgacctcagactctggacggtgaacggggatctcgttggacatgtccactgcagggagatcatctgttccgtggctttctccaaccagcctgagggagtatctatcaatgtaatcgctgggggattagaaaatggaattgtaaggttatggagcacatgggacttaaagcctgtgagagaaattacatttcccaaatcaaataagcccatcatcagccttacattttcttgtgatggccaccatttgtacacagcaaacagtgatgggaccgtgattgcctggtgtcggaaggaccagcagcgcttgaaacagccaatgttctattccttccttagcagctatgcagccgggtgaatgcgaatgaacttcacgttctccaaagcactttaactccaaactagatttgttgacttcaccagttttaggaggttgaacctaaagaaatggatgactggacaaaccatccaaataatgataaagtctattcatctgcacaaaattctgaagagtcacatgatcctaagaggaaagttctgttctattttagtgataatctggaagattgtgtcaatatgcactagccaacaagttttaagcctcgcatggtacattaaaatgatattcttaaaattttttcccaccaaggtattccaaagaaaatattaaggtctcccctttttctatgattccaaaaggaccagtagaatttaaattggttggttgattgtttatataaaacacactaaaattatattttaaaagtttactgccatgaaatactcctcccaccacacacacatgctccaaaagaggaaagaaaaaaagataatttttaggacttgataattgctttctttgagaagcaaattattcagtaggtgcctctgtaccaaatattttatggaatatctaaatactaaaataaactatgaatgaatctcaaaattaggcagtttttgccagttgctttcttagctcaaaggagaaccagaatttttttgacagccacaaacaagaatacaggtatcttggatttcagacacattctgtttcttcataaaaattttacttaaaatctgtaacgctagatattgactatccttagttgagtcactgaggtttaaacacaatggtaagtcttaaagtctgctatttacagagcattgaatctgtaccaatttgcaatagaaagccttcagtatgcaagaagtttgcatgggtattaagaacacagcctaaataaggcatttgatctaatctgcaggaagaattttcttccccaaaacagaattataaaagcttactttaaacaggaggcagaataattcttttaggaaaccatttcattctgtttctactaacctataccatctgagaattcctaaacatcttggagccgtctgtctctcccatatgatggctgtctgtatatttttacttggggtgctgctttattggctttgaaaacactgtcagataagctcagtaatatgttaccatgggataaaaatatgtatccctgcctaagaataacttgtgcatttgttatggaaatttaattcatatggtgtttacagtactacttttgtaacttccagactttctaaaacattctgcttaaaaaccatataaaatataattccaaagtctctgctgtcaagatagattcgagagaaagcacgtggccatgtatgctttaaccttaaactgcatacacatgtagtgatacctaggctgcatttagatcaccgtgtgctcaggccaggtgtgaatcctgaggtccatggaggtgcagagatgagattactcctattcacgttgaagtgatttgctttgttaacaaaaaattgcagctattgtctagctttcatttttttactgagaactttaaattagtcccctattagaatagggttgctactcatctttttttaaaaaccgaatttcatcatttatctaaagagaaaatatgcagaataactggtcttgttaagagtgcaatattatatttttatgtaaaaataaaaattaatttggggggattatttattcagcatgaaacctaatatgtatatgtttgaaatacttcataatgtgcatgttgtagcaaacatttctgtaaattatcacaagctctgttacctttatatacactgcctcttcaatttggaaataaatttc

SEQ ID NO: 150367 - DNA, 542 bp, Homo sapiens
  Payload ID: 9692
  Gene Symbol: LYST
  Gene Name: lysosomal trafficking regulator
  ENST ID: ENST00000487530
  CDS Start-End: 1-542
cattcccatgagtgaatataaattgcttgcttgtgatatacagcaacttttcatagcagttacaattcatgcttgcagttcctcaggctcacaatattttagggttattgaagaccttattgtaatgcttggatatcttcaaaatagcaaaaacaagaggacacaaaatatggctgttgcactacagcttagagttctccaggctgctatggaatttataaggaccaccgcaaatcatgactctgaaaacctcacagattcactccagtcaccttctgctccccatcatgcagtagttcaaaagcggaaaagcattgctggttcaattccaatgaagggttccattattcctcatctaccaagacatcattttggttcctatggtcaacttccgatgcccttctccttcggtccattaaatcaagactcatccccccagttttctcctggatgcactacctgtgttgtacctcctggagcaggtcctcgaaaatttccccttgctcaaactgaatcgcttctgatgaaaatgcgttcagtgg

SEQ ID NO: 150368 - DNA, 2699 bp, Homo sapiens
  Payload ID: 9693
  Gene Symbol: LAMP1
  Gene Name: lysosomal-associated membrane protein 1
  Uniprot ID: P11279
  ENST ID: ENST00000332556
  CDS Start-End: 195-1448
gtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctccccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagccggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaacatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttatttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttttggggtgggccttgtccttctgtcagctaaaatgggagctcatgagagaaggacgtcagggaaacggggttgagggtggtctcggtgcagagagaagggtgtcagggaaacggggggtgagggtggtcttggtgccagacgtagggaatggtgttgggagtggcccgagtgcctggcacagttgtctggttcattcatgtaacatgataatttttaaatcattaaaaaaattacctttcatacaga

SEQ ID NO: 150369 - DNA, 1867 bp, Homo sapiens
  Payload ID: 9694
  Gene Symbol: LAMP2
  Gene Name: lysosomal-associated membrane protein 2
  Uniprot ID: P13473
  ENST ID: ENST00000200639
  CDS Start-End: 138-1370
ccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaaggtctatcttaagaagccctggccaaattttgatcctaaccttgaagtatgccttgaacttattaacatggccattataagaataaaatatgtagttgtgtcttaatggaattaataaatgtcatttcactactggtgttctgtttcaatgtataaggactatagtgatttaaactcatcaatgtgcctttgcataaagttcattaaataaatattgatgtggtataaatgcccatcagatatgct

SEQ ID NO: 150370 - DNA, 4030 bp, Homo sapiens
  Payload ID: 9694
  Gene Symbol: LAMP2
  Gene Name: lysosomal-associated membrane protein 2
  Uniprot ID: P13473
  ENST ID: ENST00000371335
  CDS Start-End: 138-1370
ccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcattatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaa

SEQ ID NO: 150371 - DNA, 2089 bp, Homo sapiens
  Payload ID: 9694
  Gene Symbol: LAMP2
  Gene Name: lysosomal-associated membrane protein 2
  Uniprot ID: P13473
  ENST ID: ENST00000434600
  CDS Start-End: 197-1432
gagattggctgtaagcaagaaagagccccgcccctagtcttatgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctgaagaatgttctgctgactctgacctcaactttcttattcctgttgcagtgggtgtggccttgggcttccttataattgttgtctttatctcttatatgattggaagaaggaaaagtcgtactggttatcagtctgtgtaatcagttaaatctagtgtttgtttgtttttttcaattagaagttacgtttccattggctaaaagccaggacatgctgtgcaatagattgtttaagatatgcagactaacttcagtgagttcctagctaacttgggcatgagtacacttatttaagacaaaatatattaggaccaatttttttctgttttttttcttcctttgttaaagtataattaaaagaaaaattgtggcttagaattttttaagtaaataatgattttaagcccctggatccaattatgaaagcatttttgctgatgtgtaattttatatgttacagttacttatattttactactttgatgttatttgcaaaatcaaaggtgttaaagaatttaacttgcttcaggaaataaattcaagaacatagtggattcattttcattggtggcagacacgaaatttggttcatgataagacttcctttccccacctcctgatcagcattatttaaatctgtatttttctgttagttaagaaagaaatggcttcatgatattgtatttaatagcaaaagtttggctgtcttcttcattactgttaatagctactatattttaacaaggagatttctttttttgttgttgttgttctagagtttggaatatactgattatc

SEQ ID NO: 150372 - DNA, 1069 bp, Homo sapiens
  Payload ID: 9694
  Gene Symbol: LAMP2
  Gene Name: lysosomal-associated membrane protein 2
  ENST ID: ENST00000486593
  CDS Start-End: 1-776
gcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacac

SEQ ID NO: 150373 - DNA, 3375 bp, Homo sapiens
  Payload ID: 9695
  Gene Symbol: LAMP3
  Gene Name: lysosomal-associated membrane protein 3
  Uniprot ID: Q9UQV4
  ENST ID: ENST00000265598
  CDS Start-End: 257-1507
accacgcgcgtgcggtaaacggtcccagaggcccgggccccggcggctgcgccgagtccccgcccctccctgctccgtaggggtaggagggggccggcggagtttccctccccgcccagcggccctgggcgggcttttcggctgcttctcataagcaggtggtttcgtttctccggcacaggtaggtttctctggcaccgattcggggcctgcccggacttcgccgcacgctgcagaacctcgcccagcgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcgactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacaactggaaccagttcatcaaccgtcagccacacaactgggaacaccactcaacccagtaaccagaccacccttccagcaactttatcgatagcactgcacaaaagcacaaccggtcagaagcctgttcaacccacccatgccccaggaacaacggcagctgcccacaataccacccgcacagctgcacctgcctccacggttcctgggcccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacaatttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttcaggcagcacatcaatttctaaatactttttgtttattttatgaaagatatagtgagctgtttattttctagtttcctttagaatattttagccactcaaagtcaacatttgagatatgttgaattaacataatatatgtaaagtagaataagccttcaaattataaaccaagggtcaattgtaactaatactactgtgtgtgcattgaagattttattttacccttgatcttaacaaagcctttgctttgttatcaaatggactttcagtgcttttactatctgtgttttatggtttcatgtaacatacatattcctggtgtagcacttaactccttttccactttaaatttgtttttgttttttgagacggagtttcactcttgtcacccaggctggagtacagtggcacgatctcggcttatggcaacctccgcctcccgggttcaagtgattctcctgcttcagcttcccgagtagctgggattacaggcacacactaccacgcctggctaatttttgtatttttattatagacggggtttcaccatgttggccagactggtcttgaactcttgacctcaggtgatccacccacctcagcctcccaaagtgctgggattacaggcatgagccattgcgcccggccttaaatgttttttttaatcatcaaaaagaacaacatatctcaggttgtctaagtgtttttatgtaaaaccaacaaaaagaacaaatcagcttatattttttatcttgatgactcctgctccagaatcgctagactaagaattaggtggctacagatggtagaactaaacaataagcaagagacaataataatggcccttaattattaacaaagtgccagagtctaggctaagcactttatctatatctcatttcattctcacaacttataggtgaatgagtaaactgagacttaagggaactgaatcacttaaatgtcacctggctaactgatggcagagccagagcttgaattcatgttggtctgacatcaaggtctttggtcttctccctacaccaagttacctacaagaacaatgacaccacactctgcctgaaggctcacacctcataccagcatacgctcaccttacagggaaatgggtttatccaggatcatgagacattagggtagatgaaaggagagctttgcagataacaaaatagcctatccttaataaatcctccactctctggaaggagactgaggggctttgtaaaacattagtcagttgctcatttttatgggattgcttagctgggctgtaaagatgaaggcatcaaataaactcaaagtatttttaaatttttttgataatagagaaacttcgctaaccaactgttctttcttgagtgtatagccccatcttgtggtaacttgctgcttctgcacttcatatccatatttcctattgttcactttattctgtagagcagcctgccaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaataaaacattgaattgtagtaaaggtttttgtaataaaaacttactttggaga

SEQ ID NO: 150374 - DNA, 1453 bp, Homo sapiens
  Payload ID: 9695
  Gene Symbol: LAMP3
  Gene Name: lysosomal-associated membrane protein 3
  ENST ID: ENST00000466939
  CDS Start-End: 119-1297
aactgtctccgtccctaccgcccggctaacatgctcaagcagggggcgcggtggcccttgcttgtaacatgaatgctaggaatgttagggaagagtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcgactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacaactggaaccagttcatcaaccgtcagccacacaactgggaacaccactcaacccagtaaccagaccacccttccagcaactttatcgatagcactgcacaaaagcacaaccggtcagaagcctgttcaacccacccatgccccaggaacaacggcagctgcccacaataccacccgcacagctgcacctgcctccacggttcctgggcccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacaatttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttc

SEQ ID NO: 150375 - DNA, 835 bp, Homo sapiens
  Payload ID: 9695
  Gene Symbol: LAMP3
  Gene Name: lysosomal-associated membrane protein 3
  ENST ID: ENST00000476015
  CDS Start-End: 296-835
ggagtcggcagcgcgagctcccagccagacctagcgcctctgggctgtgctcctgttgcttcccgcaaaccgcggtcctggcgaggcctgggcgtggagcgcggctgccgcagactccctgggaagacatggagtcagggtgcttaggggtttttaggctcctgctcgcctagtggctggctttctcccggctgagaagcgtctctgggttcccagaaaggtaggtttctctggcaccgattcggggcctgcccggacttcgccgcacgctgcagaacctcgcccagcgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcgactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacaactggaaccagttcatcaaccgtcagccacacaactgggaacaccactcaacccagtaaccagaccacccttccagcaactttatcgatagcactgcacaaaagcaca

SEQ ID NO: 150376 - DNA, 829 bp, Homo sapiens
  Payload ID: 9695
  Gene Symbol: LAMP3
  Gene Name: lysosomal-associated membrane protein 3
  ENST ID: ENST00000470251
  CDS Start-End: 401-829
ggcccgggccccggcggctgcgccgagtccccgcccctccctgctccgtaggggtaggagggggccggcggagtttccctccccgcccagcggccctgggcgggcttttcggctgcttctcataagcaggtggtttcgtttctccggcacaggtaggtttctctggcaccgattcggggcctgcccggacttcgccgcacgctgcagaacctcgcccagcgcccaccatgccccggcagctcagcgcggcggccgcgctcttcgcgtccctggccgggctcatcagcacatggtaattaacaatgatggacatggcttcctggcactctctgcatgccaggcactgttcgcagtgctttaatccacaaaacagcttttaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcgactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacaactggaaccagttcatcaaccgtcagccacacaactgggaacaccactcaacccagtaaccagaccacc

SEQ ID NO: 150377 - DNA, 2039 bp, Homo sapiens
  Payload ID: 9696
  Gene Symbol: LAMP5
  Gene Name: lysosomal-associated membrane protein family, member 5
  Uniprot ID: Q9UJQ1
  ENST ID: ENST00000246070
  CDS Start-End: 493-1335
tgcgttttcagaagacagtactccagtgataaggtatctacaccacttaataactgtacctggtaaggagatttaataaggctgagggtggtattaagtttctcagaacagactcatctttgcggatgcagttgcagaacaggaaacagacccagggagaagtttagtccccccagatctcattggccctccgcacaagccaagccacagccactcctgccacacaatcggattgctttcagcactcgcagccgtggaccgccgtgcggtcctttcctccgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 150378 - DNA, 1309 bp, Homo sapiens
  Payload ID: 9696
  Gene Symbol: LAMP5
  Gene Name: lysosomal-associated membrane protein family, member 5
  Uniprot ID: Q9UJQ1
  ENST ID: ENST00000427562
  CDS Start-End: 496-1206
agatgcgttttcagaagacagtactccagtgataaggtatctacaccacttaataactgtacctggtaaggagatttaataaggctgagggtggtattaagtttctcagaacagactcatctttgcggatgcagttgcagaacaggaaacagacccagggagaagtttagtccccccagatctcattggccctccgcacaagccaagccacagccactcctgccacacaatcggattgctttcagcactcgcagccgtggaccgccgtgcggtcctttcctccgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatgaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagcta

SEQ ID NO: 150379 - DNA, 1530 bp, Homo sapiens
  Payload ID: 9697
  Gene Symbol: LYZ
  Gene Name: lysozyme
  Uniprot ID: P61626
  ENST ID: ENST00000261267
  CDS Start-End: 69-515
gttaaaagatgttaaatactggggccagctcaccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttacattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 150380 - DNA, 669 bp, Homo sapiens
  Payload ID: 9697
  Gene Symbol: LYZ
  Gene Name: lysozyme
  ENST ID: ENST00000549690
  CDS Start-End: 26-439
ctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttacattaagcctacaacatttttcagtttgcaaatagaactaatactggtgaaaatttacctaaaaccttggttatcaaatacatctccagtacattccgt

SEQ ID NO: 150381 - DNA, 558 bp, Homo sapiens
  Payload ID: 9697
  Gene Symbol: LYZ
  Gene Name: lysozyme
  ENST ID: ENST00000548839
  CDS Start-End: 24-338
agcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtggtaagacaagctaatatttgaccaatctggttatacttacaagaattgagactcaatacaaatgaaaaagccttgaaaggttcatgagggacctagaaaaactacatctcaacttccagaaagtcattattattttcctcataattccctgagtaagaaattaaagaagtggtatcataaaaggttgatgttttttaatatacagaagtttctggaatgacctattaatttact

SEQ ID NO: 150382 - DNA, 990 bp, Homo sapiens
  Payload ID: 9698
  Gene Symbol: LYG1
  Gene Name: lysozyme G-like 1
  Uniprot ID: Q8N1E2
  ENST ID: ENST00000308528
  CDS Start-End: 251-835
ataatttatgagatgtcataaatctctccaaaataggatgagatgaacacttttaacaagagaacaggactctatataaatcgctgtgggctcaccacctctaaggaggagcactgactgaagacagaaaaattgatgaactgaagaagacatggtccattatgccttacaaacttacacagtgctttgggaattccaaagtactcagtggagagaggtgtttcaggagccgtagagccagatcgtcatcatgtctgcattgtggctgctgctgggcctccttgccctgatggacttgtctgaaagcagcaactggggatgctatggaaacatccaaagcctggacacccctggagcatcttgtgggattggaagacgtcacggcctgaactactgtggagttcgtgcttctgaaaggctggctgaaatagacatgccatacctcctgaaatatcaacccatgatgcaaaccattggccaaaagtactgcatggatcctgccgtgatcgctggtgtcttgtccaggaagtctcccggtgacaaaattctggtcaacatgggcgataggactagcatggtgcaggaccctggctctcaagctcccacatcctggattagtgagtctcaggtttcccagacaactgaagttctgactactagaatcaaagaaatccagaggaggtttccaacctggacccctgaccagtacctgagaggtggactctgtgcctacagtgggggtgctggctatgtccgaagcagccaggacctgagctgtgacttctgcaatgatgtccttgcacgagccaagtacctcaagagacatggcttctaacatctcagatgaaacccaagaccatgatcacatatgcagcctcaaatgttacacagataaaactagccaagggcacctgtaactgggaatctgagtttgacctaaaagtcattaaaataacatgaatcacattaaaggaagaattttgacctgca

SEQ ID NO: 150383 - DNA, 1038 bp, Homo sapiens
  Payload ID: 9698
  Gene Symbol: LYG1
  Gene Name: lysozyme G-like 1
  Uniprot ID: Q8N1E2
  ENST ID: ENST00000409448
  CDS Start-End: 318-902
gttgctatgttgcccaggctggtcttgaagtgccttgacctcctaaagtgttggaaccacagacgtgagccactccacccagcctaaaacttcatcttctttggatgagatgaacacttttaacaagagaacaggactctatataaatcgctgtgggctcaccacctctaaggaggagcactgactgaagacagaaaaattgatgaactgaagaagacatggtccattatgccttacaaacttacacagtgctttgggaattccaaagtactcagtggagagaggtgtttcaggagccgtagagccagatcgtcatcatgtctgcattgtggctgctgctgggcctccttgccctgatggacttgtctgaaagcagcaactggggatgctatggaaacatccaaagcctggacacccctggagcatcttgtgggattggaagacgtcacggcctgaactactgtggagttcgtgcttctgaaaggctggctgaaatagacatgccatacctcctgaaatatcaacccatgatgcaaaccattggccaaaagtactgcatggatcctgccgtgatcgctggtgtcttgtccaggaagtctcccggtgacaaaattctggtcaacatgggcgataggactagcatggtgcaggaccctggctctcaagctcccacatcctggattagtgagtctcaggtttcccagacaactgaagttctgactactagaatcaaagaaatccagaggaggtttccaacctggacccctgaccagtacctgagaggtggactctgtgcctacagtgggggtgctggctatgtccgaagcagccaggacctgagctgtgacttctgcaatgatgtccttgcacgagccaagtacctcaagagacatggcttctaacatctcagatgaaacccaagaccatgatcacatatgcagcctcaaatgttacacagataaaactagccaagggcacctgtaactgggaatctgagtttgacctaaaagtcattaaaataacatgaatcacattaaa

SEQ ID NO: 150384 - DNA, 862 bp, Homo sapiens
  Payload ID: 9699
  Gene Symbol: LYG2
  Gene Name: lysozyme G-like 2
  Uniprot ID: Q86SG7
  ENST ID: ENST00000333017
  CDS Start-End: 114-752
gtaaaagcttgaagtgcagtttgctgctgagtacagaagacctttgcaaacagagaggggagattttctctgtaaggttgcaaacaaggtcctggaagataagattccccgccatgttatcctccgtggtgttttggggactaattgccctcattggcacttccaggggctcataccccttcagtcactcaatgaagcctcacctacatccacgcctgtaccacggctgctatggggacatcatgaccatgaagacctctggggccacttgtgatgcaaacagtgtgatgaactgcgggatccgtggttctgaaatgtttgctgagatggatttgagggccataaaaccttaccagactctgatcaaagaagtcgggcagagacattgcgtggaccctgctgtcatcgcagccatcatctccagggaaagccatggcggatctgtcctgcaagacggctgggaccacaggggacttaaatttggcttgatgcagcttgataaacaaacgtaccaccctgtcggtgcctgggatagcaaagagcacctttcacaggctactgggattctaacagagagaattaaggcaatccagaaaaaattccccacgtggagtgttgctcagcacctcaaaggtggtctctcagcttttaagtcaggaattgaagcgattgccaccccatcggacatagacaatgacttcgtcaatgatatcattgctcgagctaagttctataaaagacaaagcttctaggcaaagctctgtgggtgggccaggttggcagagtgctcagatggccgcctttgagagttttacgtgaatgtgttgtatacaacactggcaaagaaatgattaaaatcatg

SEQ ID NO: 150385 - DNA, 878 bp, Homo sapiens
  Payload ID: 9699
  Gene Symbol: LYG2
  Gene Name: lysozyme G-like 2
  ENST ID: ENST00000409679
  CDS Start-End: 146-694
agcctatgttacaggacaaaggccgtcgctttgtaaaagcttgaagtgcagtttgctgctgagtacagaagacctttgcaaacagagaggggagattttctctgtaaggttgcaaacaaggtcctggaagataagattccccgccatgttatcctccgtggtgttttggggactaattgccctcattggcacttccaggggctcataccccttcagtcactcaatgaagcctcacctacatccacgcctgtaccacggctgctatggggacatcatgaccatgaagacctctggggccacttgtgatgcaaacagtgtgatgaactgcgggatccgtggttctgaaatgtttgctgagatggatttgagggccataaaaccttaccagactctgatcaaagaagtcgggcagagacattgcgtggaccctgctgtcatcgcagccatcatctccagggaaagccatggcggatctgtcctgcaagacggctgggaccacaggggacttaaatttggcttgatgcagcttgataaacaaacgtaccaccctgtcggtgcctgggatagcaaagagcacctttcacaggctactgggattctaacagagagaattaaggcaatccagaaaaaattccccacgtggagtgttgctcagcacctcaaaggtaggctgtattctgagtactttgtttaaatgagcaatgaatgagaccactgaaggccagtgtgacccgagactccctgggagcatttccacggggtcagcagtggccctgggaggagctgtctagaggctgcatttgcattccctgaaccactgagttactttgagaggtcctccatcctcaacctccatttcctcttctgcagaatgttgg

SEQ ID NO: 150386 - DNA, 778 bp, Homo sapiens
  Payload ID: 9699
  Gene Symbol: LYG2
  Gene Name: lysozyme G-like 2
  Uniprot ID: Q86SG7
  ENST ID: ENST00000409238
  CDS Start-End: 22-660
tggaagataagattccccgccatgttatcctccgtggtgttttggggactaattgccctcattggcacttccaggggctcataccccttcagtcactcaatgaagcctcacctacatccacgcctgtaccacggctgctatggggacatcatgaccatgaagacctctggggccacttgtgatgcaaacagtgtgatgaactgcgggatccgtggttctgaaatgtttgctgagatggatttgagggccataaaaccttaccagactctgatcaaagaagtcgggcagagacattgcgtggaccctgctgtcatcgcagccatcatctccagggaaagccatggcggatctgtcctgcaagacggctgggaccacaggggacttaaatttggcttgatgcagcttgataaacaaacgtaccaccctgtcggtgcctgggatagcaaagagcacctttcacaggctactgggattctaacagagagaattaaggcaatccagaaaaaattccccacgtggagtgttgctcagcacctcaaaggtggtctctcagcttttaagtcaggaattgaagcgattgccaccccatcggacatagacaatgacttcgtcaatgatatcattgctcgagctaagttctataaaagacaaagcttctaggcaaagctctgtgggtgggccaggttggcagagtgctcagatggccgcctttgagagttttacgtgaatgtgttgtatacaacactggcaaagaaatgattaaaatcatgaaagaaaa

SEQ ID NO: 150387 - DNA, 766 bp, Homo sapiens
  Payload ID: 9699
  Gene Symbol: LYG2
  Gene Name: lysozyme G-like 2
  Uniprot ID: Q86SG7
  ENST ID: ENST00000423800
  CDS Start-End: 22-558
tggaagataagattccccgccatgttatcctccgtggtgttttggggactaattgccctcattggcacttccaggggctcataccccttcagtcactcaatgaagcctcacctacatccacgcctgtaccacggctgctatggggacatcatgaccatgaagacctctggggccacttgtgatgcaaacagtgtgatgaactgcgggatccgtggttctgaaatgtttgctgagatggatttgagggccataaaaccttaccagactctgatcaaagaagtcgggcagagacattgcgtggaccctgctgtcatcgcagccatcatctccagggaaagccatggcggatctgtcctgcaagacggctgggaccacaggggacttaaatttggcttgatgcagcttgataaacaaacgtaccaccctgtcggtgcctgggatagcaaagagcacctttcacaggctactgggattctaacagagagaattaaggcaatccagaaaaaattccccacgtggagtgttgctcagcacctcaaaggttttttcctgttataagaaactgtcaacaactttccaaattgtctgaacaatgttactctgtggtctctcagcttttaagtcaggaattgaagcgattgccaccccatcggacatagacaatgacttcgtcaatgatatcattgctcgagctaagttctataaaagacaaagcttctaggcaaagctctgtgggtgggccaggttggcagagtgctcagatggc

SEQ ID NO: 150388 - DNA, 682 bp, Homo sapiens
  Payload ID: 9699
  Gene Symbol: LYG2
  Gene Name: lysozyme G-like 2
  ENST ID: ENST00000423306
  CDS Start-End: 174-682
acaggacgaaggtaagaaaagccagcctatgttacaggacaaaggccgtcgctttgtaaaagcttgaagtgcagtttgctgctgagtacagaagacctttgcaaacagagaggggagattttctctgtaaggttgcaaacaagagcaggtcctggaagataagattccccgccatgttatcctccgtggtgttttggggactaattgccctcattggcacttccaggggctcataccccttcagtcactcaatgaagcctcacctacatccacgcctgtaccacggctgctatggggacatcatgaccatgaagacctctggggccacttgtgatgcaaacagtgtgatgaactgcgggatccgtggttctgaaatgtttgctgagatggatttgagggccataaaaccttaccagactctgatcaaagaagtcgggcagagacattgcgtggaccctgctgtcatcgcagccatcatctccagggaaagccatggcggatctgtcctgcaagacggctgggaccacaggggacttaaatttggcttgatgcagcttgataaacaaacgtaccaccctgtcggtgcctgggatagcaaagagcacctttcacaggctactgggattctaacagagagaattaaggcaatccagaaaaaattccccacgtggagtgttgctca

SEQ ID NO: 150389 - DNA, 650 bp, Homo sapiens
  Payload ID: 9699
  Gene Symbol: LYG2
  Gene Name: lysozyme G-like 2
  Uniprot ID: Q86SG7
  ENST ID: ENST00000626374
  CDS Start-End: 114-650
gtaaaagcttgaagtgcagtttgctgctgagtacagaagacctttgcaaacagagaggggagattttctctgtaaggttgcaaacaaggtcctggaagataagattccccgccatgttatcctccgtggtgttttggggactaattgccctcattggcacttccaggggctcataccccttcagtcactcaatgaagcctcacctacatccacgcctgtaccacggctgctatggggacatcatgaccatgaagacctctggggccacttgtgatgcaaacagtgtgatgaactgcgggatccgtggttctgaaatgtttgctgagatggatttgagggccataaaaccttaccagactctgatcaaagaagtcgggcagagacattgcgtggaccctgctgtcatcgcagccatcatctccagggaaagccatggcggatctgtcctgcaagacggctgggaccacaggggacttaaatttggcttgatgcagcttgataaacaaacgtaccaccctgtcggtgcctgggatagcaaagagcacctttcacaggctactgggattctaacagagagaattaaggcaatccagaaaaaattccccacgtggagtgttgctcagcacctcaaaggttttttcctgttataa

SEQ ID NO: 150390 - DNA, 815 bp, Homo sapiens
  Payload ID: 9700
  Gene Symbol: LYZL1
  Gene Name: lysozyme-like 1
  Uniprot ID: Q6UWQ5
  ENST ID: ENST00000375500
  CDS Start-End: 58-642
tcttgagctaggaaaggattactcgcgcctcgttagaatcagacatggcttcaggggatgcaggacgctcccctgagctgcctgtcaccgactaagtggagcagtgtttcttccgcagactcaactgagaagtcagcctctggggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcatattatgagagcggctacaacaccacagcccagacggtcctggatgacggcagcatcgactatggcatcttccagatcaacagcttcgcgtggtgcagacgcggaaagctgaaggagaacaaccactgccatgtcgcctgctcagccttgatcactgatgacctcacagatgcaattatctgtgccaggaaaattgttaaagagacacaaggaatgaactattggcaaggctggaagaaacattgtgagggcagagacctgtccgagtggaaaaaaggctgtgaggtttcctaaactggaactggacccaggatgctttgcagcaacgccctaggatttgcagtgaatgtccaaatgcctgtgtcatcttgtcccgtttcctcccaatattccttctcaaacttggagagggaaaattaagctatacttttaagaaaataaatatttccatttaaatgtcttcaccc

SEQ ID NO: 150391 - DNA, 637 bp, Homo sapiens
  Payload ID: 9700
  Gene Symbol: LYZL1
  Gene Name: lysozyme-like 1
  ENST ID: ENST00000494304
  CDS Start-End: 1-321
aaaatctacactcgttgcaaactggcaaaaatattctcgagggctggcctggacaattactggggcttcagccttggaaactggatctgcatggcatattatgagagcggctacaacaccacagcccagacggtcctggatgacggcagcatcgactatggcatcttccagatcaacagcttcgcgtggtgcagacgcggaaagctgaaggagaacaaccactgccatgtcgcctgctcagccttgatcactgatgacctcacagatgcaattatctgtgccaggaaaattgttaaagagacacaaggaatgaactattgaagtcctcagcacatgttcttcatggaggtcatctttccctggactgcttggctactttagaagtcaaatcaagactagaagtatgaaagccaatcacaatttcccaacaattaggatccatcattcaccatttggttggtccctgctgctaagaattccaaactacaagggaaaaagttaaactcagctagatttccctgcctgctcaagaccacaaccccagtggcaacataattcttggtgaggatgaaaaaacgaaatctatacttgccttgagaaagcattcatgcaaaataaagcccagattcataagtaa

SEQ ID NO: 150392 - DNA, 818 bp, Homo sapiens
  Payload ID: 9701
  Gene Symbol: LYZL2
  Gene Name: lysozyme-like 2
  Uniprot ID: Q7Z4W2
  ENST ID: ENST00000375318
  CDS Start-End: 58-642
tcttgagctaggaaaggattactcgagccttgttagaatcagacatggcttcaggggatgcaggacgctcccctgagctgcctgtcaccgactaagtggagcagtgtttcttccgcagactcaactgagaagtcagcctctgcggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcgtattatgagagcggctacaacaccacagcccagacggtcctggatgacggcagcatcgactacggcatcttccagatcaacagcttcgcgtggtgcagacgcggaaagctgaaggagaacaaccactgccacgtcgcctgctcagccttggtcactgatgacctcacagatgcgattatctgtgccaagaaaattgttaaagagacacaaggaatgaactattggcaaggctggaagaaacactgtgaggggagagacctgtccgactggaaaaaagactgtgaggtttcctaaactggaactggacccaggatgctttgcagcaacgccctagggtttgcagtgaatgtccaaatgcctgtgtcatcttgtcccgtttcctcccaatattccttctcaaacttggagagggaaaattaagctatacttttaagaaaataaatatttccatttaaatgtcttcaccctga

SEQ ID NO: 150393 - DNA, 904 bp, Homo sapiens
  Payload ID: 9702
  Gene Symbol: LYZL4
  Gene Name: lysozyme-like 4
  Uniprot ID: Q96KX0
  ENST ID: ENST00000287748
  CDS Start-End: 277-717
gtcatggagaactcttgggtgcagacaagtggatgattaatgaagtagcatctgaaaaacccaaggaaccaaatgtaggtggagcaacttccctgcaacacacgtcgaagctgctgcagtggctgttcttcccctccccttggaaaggcaccaaaagccagcctttggaagggctggtggactgtgcccttctttcccttcagagaaccagtgtccctgtgactccacccactcatctggccaccgttgccctgacctgccaggagcctggagaagatgaaggcatccgtggttctctccctccttggctacctggtggttccaagtggtgcttacatcttggggcgttgcacagtggctaagaaactccacgatggaggcctggattattttgagggctatagccttgagaactgggtgtgcctggcctacttcgagagcaagttcaaccccatggccatctacgagaacacacgtgagggctacactggctttggcctctttcagatgcgtggcagtgactggtgtggcgaccatggcaggaaccgctgccatatgtcatgttccgctttactgaatcctaatttagagaagacaattaaatgtgccaagaccattgtaaaaggaaaagaagggatgggagcatggcccacctggtcccggtactgccagtactccgataccctggcacggtggctggatggttgcaagctgtagccacctgcatggcccctgcagcactcaccagttgcatcttgtgaatgaaggtgcttttctgcttgctgcttcagtcaatccttttgatgatctcaccactttaagagttccagatggaaaaagacaaaagtttgcttcatccggggatgcaggatgcagaataaaccaaactagttactcaacttgg

SEQ ID NO: 150394 - DNA, 838 bp, Homo sapiens
  Payload ID: 9702
  Gene Symbol: LYZL4
  Gene Name: lysozyme-like 4
  Uniprot ID: Q96KX0
  ENST ID: ENST00000441172
  CDS Start-End: 216-656
aagtagcatctgaaaaacccaaggaaccaaatgtaggtggagcaacttccctgcaacacacgtcgaagctgctgcagtggctgttcttcccctccccttggaaaggcaccaaaagccagcctttggaagggctggtggactgagaaccagtgtccctgtgactccacccactcatctggccaccgttgccctgacctgccaggagcctggagaagatgaaggcatccgtggttctctccctccttggctacctggtggttccaagtggtgcttacatcttggggcgttgcacagtggctaagaaactccacgatggaggcctggattattttgagggctatagccttgagaactgggtgtgcctggcctacttcgagagcaagttcaaccccatggccatctacgagaacacacgtgagggctacactggctttggcctctttcagatgcgtggcagtgactggtgtggcgaccatggcaggaaccgctgccatatgtcatgttccgctttactgaatcctaatttagagaagacaattaaatgtgccaagaccattgtaaaaggaaaagaagggatgggagcatggcccacctggtcccggtactgccagtactccgataccctggcacggtggctggatggttgcaagctgtagccacctgcatggcccctgcagcactcaccagttgcatcttgtgaatgaaggtgcttttctgcttgctgcttcagtcaatccttttgatgatctcaccactttaagagttccagatggaaaaagacaaaagtttgcttcatccggggatgcaggatgcagaataaaccaaactagttactcaa

SEQ ID NO: 150395 - DNA, 322 bp, Homo sapiens
  Payload ID: 9703
  Gene Symbol: LYZL6
  Gene Name: lysozyme-like 6
  ENST ID: ENST00000617692
  CDS Start-End: 1-260
agctggaggacttggatgggtttgagggttactccctgagtgactggctgtgcctggcttttgtggaaagcaagttcaacatatcaaagataaatgaaaatgcagacggaagctttgactatggcctcttccagatcaacagccactactggtgcaacgattataagagttactcggaaaacctttgccacgtagactgtcaaggcatccactgcgcaaaaaggattgtgtccggagcacgggggatgaacaactggtgaggaggacacggtgggactcagcgggcagagccccacgaaggaggacgtgacagagaaaaggg

SEQ ID NO: 150396 - DNA, 917 bp, Homo sapiens
  Payload ID: 9703
  Gene Symbol: LYZL6
  Gene Name: lysozyme-like 6
  Uniprot ID: O75951
  ENST ID: ENST00000618542
  CDS Start-End: 193-639
ggtgaggaagaagaggctcctactgtagacagccttgttctacagatcctcccagaaatctctgggccaggtggaacccagggtcagagagggatgggagagagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataaatgaaaatgcagacggaagctttgactatggcctcttccagatcaacagccactactggtgcaacgattataagagttactcggaaaacctttgccacgtagactgtcaagatctgctgaatcccaaccttcttgcaggcatccactgcgcaaaaaggattgtgtccggagcacgggggatgaacaactgggtagaatggaggttgcactgttcaggccggccactcttctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcgaaatattaaagcactcgctctgcaaa

SEQ ID NO: 150397 - DNA, 917 bp, Homo sapiens
  Payload ID: 9703
  Gene Symbol: LYZL6
  Gene Name: lysozyme-like 6
  Uniprot ID: O75951
  ENST ID: ENST00000612374
  CDS Start-End: 193-639
ggtgaggaagaagaggctcctactgtagacagccttgttctacagatcctcccagaaatctctgggccaggtggaacccagggtcagagagggatgggagagagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataaatgaaaatgcagatggaagctttgactatggcctcttccagatcaacagccactactggtgcaacgattataagagttactcggaaaacctttgccacgtagactgtcaagatctgctgaatcccaaccttcttgcaggcatccactgcgcaaaaaggattgtgtccggagcacgggggatgaacaactgggtagaatggaggttgcactgttcaggccggccactcttctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcgaaatattaaagcactcgctctgcaaa

SEQ ID NO: 150398 - DNA, 1047 bp, Homo sapiens
  Payload ID: 9703
  Gene Symbol: LYZL6
  Gene Name: lysozyme-like 6
  Uniprot ID: O75951
  ENST ID: ENST00000615905
  CDS Start-End: 336-782
tgttagttgggcagggctgaagtgtatgtggtgaggaagaagaggctcctactgtagacagccttgttctacagatcctcccagaaatctctgggccaggtggaacccagggtcagagagggatgggagagaggtttaattttccatgataaataaaaatctataaaataataaacaagagaaaagagattggaaacagccaggttggagcagtgagtgagtaaggaaacctggctgccctctccagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataaatgaaaatgcagacggaagctttgactatggcctcttccagatcaacagccactactggtgcaacgattataagagttactcggaaaacctttgccacgtagactgtcaagatctgctgaatcccaaccttcttgcaggcatccactgcgcaaaaaggattgtgtccggagcacgggggatgaacaactgggtagaatggaggttgcactgttcaggccggccactcttctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcgaaatattaaagca

SEQ ID NO: 150399 - DNA, 322 bp, Homo sapiens
  Payload ID: 9703
  Gene Symbol: LYZL6
  Gene Name: lysozyme-like 6
  ENST ID: ENST00000633033
  CDS Start-End: 1-260
agctggaggacttggatgggtttgagggttactccctgagtgactggctgtgcctggcttttgtggaaagcaagttcaacatatcaaagataaatgaaaatgcagatggaagctttgactatggcctcttccagatcaacagccactactggtgcaacgattataagagttactcggaaaacctttgccacgtagactgtcaaggcatccactgcgcaaaaaggattgtgtccggagcacgggggatgaacaactggtgaggaggacacggtgggactcagcgggcagagccccacgaaggaggacgtgacagagaaaaggg

SEQ ID NO: 150400 - DNA, 1047 bp, Homo sapiens
  Payload ID: 9703
  Gene Symbol: LYZL6
  Gene Name: lysozyme-like 6
  ENST ID: ENST00000632590
  CDS Start-End: 336-782
tgttagttgggcagggctgaagtgtatgtggtgaggaagaagaggctcctactgtagacagccttgttctacagatcctcccagaaatctctgggccaggtggaacccagggtcagagagggatgggagagaggtttaattttccatgataaataaaaatctataaaataataaacaagagaaaagagattggaaacagccaggttggagcagtgagtgagtaaggaaacctggctgccctctccagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataaatgaaaatgcagatggaagctttgactatggcctcttccagatcaacagccactactggtgcaacgattataagagttactcggaaaacctttgccacgtagactgtcaagatctgctgaatcccaaccttcttgcaggcatccactgcgcaaaaaggattgtgtccggagcacgggggatgaacaactgggtagaatggaggttgcactgttcaggccggccactcttctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcgaaatattaaagca

SEQ ID NO: 150401 - DNA, 5102 bp, Homo sapiens
  Payload ID: 9704
  Gene Symbol: LOX
  Gene Name: lysyl oxidase
  Uniprot ID: P28300
  ENST ID: ENST00000231004
  CDS Start-End: 301-1554
aaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctggttcctgaatctgactataccaacaatgttgtgcgctgtgacattcgctacacaggacatcatgcgtatgcctcaggctgcacaatttcaccgtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctgaaatgtctgccttttaaatataacacctactatttggttaattttgacgatttttttttttcaattaggaagctaaaaatactactttattccttatatgaacattcatccccctcctggcacctctaaacacacccaaataactcacaagtactgatttaacactctgtattactgaacttctttgaactattttgaactttgaatctcttctctgaataactgccgaaactcaaagataataattagttgatgaaggttatcaattaataaaataacacagaccagtcttaccaaactctaaatacattttaaaaaataggaactggcaatgataaaaagaatgttgagtactgacaggagattggcttttacactaaaaaagacagaaaatggactaaataggaacataatttcagagtttatgagtcagtttacaatatgccatattagcgatctcatgatgattcagaccacagtctgggttaaagatgtcttgacctctgaggctagcataacatatatgagaatacaacttgcctatttccagaaaatctgtatatttttatagaataactttatttacaatttctatcatccaattactcactaggcattatttgtagtactttttttctctttgaaatctcataggatagtcacacttataaacattcccaatattcggattctagaagaaatgcaattcattaaaattttcctggcactgagagttaatctttagcagattgcatgaaaatactgaattcctggtaaggagatattttgttttaaaaataatgtgttttgatacgaatcagtgtattaactgataactaaaaagtactcttttttctatatatacatatttttttgaactcatattcacaatcaacatattcaatcagtgagttaagtctcattcctagctaccaaaattcctgggccacttttaaacactaaacatttcatttatcctctaagctaaaatggtgctgagttatttaaatctgaatgtaaaatgcattaaatcttagcttgtggtatataaacatttaattaatataaaactgcttgctataaactaagtaacatgtcatttggtgttaggtttttagtgaagttttagcttctcccaaatttttcaggaatgttatttgtaagacgtgtaacttttttgaagaactcttattttaaatgctcagacattggctttatgttcctctttgcattctcatattcttttattatacatctatactatgattgcaagattatataaaaatgccttgaataaatgatttcaagtgtc

SEQ ID NO: 150402 - DNA, 561 bp, Homo sapiens
  Payload ID: 9704
  Gene Symbol: LOX
  Gene Name: lysyl oxidase
  ENST ID: ENST00000508067
  CDS Start-End: 1-186
tacaacccctacaagtactctgacgacaacccttattacaactactacgatacttatgaaaggcccagacctgggggcaggtaccggcccggatacggcactggctacttccagtacgtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagctggaggtgctataaggctgagtaataaatacttctcaagggagatgaaatataagtatagttttatgtcagactcttggattgagtcctggctgttatgatacctatggtgcagacatagactgccagtggattgatattacagatg

SEQ ID NO: 150403 - DNA, 2351 bp, Homo sapiens
  Payload ID: 9705
  Gene Symbol: LOXL1
  Gene Name: lysyl oxidase-like 1
  Uniprot ID: Q08397
  ENST ID: ENST00000261921
  CDS Start-End: 327-2051
attcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtctccctgacttggtcccagaccccaactatgtgcaagcatccacttatgtgcagagagcccacctgtactccctgcgctgtgctgcggaggagaagtgtctggccagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccagggcctgagcccaggctgctatgacacctacaatgcggacatcgactgccagtggatcgacataaccgacgtgcagcctgggaactacatcctcaaggtgcacgtgaacccaaagtatattgttttggagtctgacttcaccaacaacgtggtgagatgcaacattcactacacaggtcgctacgtttctgcaacaaactgcaaaattgtccaatcctgatctccgggagggacagatggccaatctctccccttccaaagcaggccctgctccccgggcagcctcccgccgaggggcccagcccccaacccacaggcacggaggggcatccctccctgccggcctcagggagcgaacgtggatgaaaaccacagggattccggacgccagaccccattttatacttcacttttctctacagtgttgttttgttgttgttggtttttattttttatactttggccataccacagagctagattgcccaggtctgggctgaataaaacaaggtttttctac

SEQ ID NO: 150404 - DNA, 2786 bp, Homo sapiens
  Payload ID: 9705
  Gene Symbol: LOXL1
  Gene Name: lysyl oxidase-like 1
  ENST ID: ENST00000566011
  CDS Start-End: 796-2091
gggataatggtggaaggaacatgcaaagagggtgtgtcttaattagcactggctttagggaacaaggaaaagggagaacccgggagtacgggaaggaggctggggcagacaggagtcagaggcccattccagcccaaacgagaagccagtgagcaaggtggagaccagggatgctgtgaccaaagcagagaggaatgggcggggtggtgctgacaccccagccccgttctgcctgccagagccccacttaccaggcccgagtccccagaggtcccctcctactccctgctcgattcccttcctcagaggcaggtctgtggcttggctgggaactccagggactgagggagcactgcagctgtgggaccggcgcatagctaaaagccggcgggccatagggccccgcggaggaggccccagcaggcggaccaggaggccgaagcctcccgacgctcccagcctgttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcgtaactcctgctcagactcctgcatgcccagggaggaaggtggaggggcaggaacaggacggacaggccccgggctctggcacatcctggggaacaagggaccacaaggacgggggcagtctccagacttcccctgggcgcttgaccccaggccttgcaggggagagagccagggcctccctcaggtctccctgacttggtcccagaccccaactatgtgcaagcatccacttatgtgcagagagcccacctgtactccctgcgctgtgctgcggaggagaagtgtctggccagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccagggcctgagcccaggctgctatgacacctacaatgcggacatcgactgccagtggatcgacataaccgacgtgcagcctgggaactacatcctcaaggtgcacgtgaacccaaagtatattgttttggagtctgacttcaccaacaacgtggtgagatgcaacattcactacacaggtcgctacgtttctgcaacaaactgcaaaattgtccaatcctgatctccgggagggacagatggccaatctctccccttccaaagcaggccctgctccccgggcagcctcccgccgaggggcccag

SEQ ID NO: 150405 - DNA, 3549 bp, Homo sapiens
  Payload ID: 9706
  Gene Symbol: LOXL2
  Gene Name: lysyl oxidase-like 2
  Uniprot ID: Q9Y4K0
  ENST ID: ENST00000389131
  CDS Start-End: 371-2695
acaacaaaagaggccggaggccgggcctgctgcggcggccgccttcggggaagggggtgggtccggggaggggtttgccatcctcctctagttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcaagattccggaaagcgtacaagccagagcaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcatgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgcgggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacagcccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaaga

SEQ ID NO: 150406 - DNA, 689 bp, Homo sapiens
  Payload ID: 9706
  Gene Symbol: LOXL2
  Gene Name: lysyl oxidase-like 2
  ENST ID: ENST00000518878
  CDS Start-End: 1-204
cggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaacaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccag

SEQ ID NO: 150407 - DNA, 975 bp, Homo sapiens
  Payload ID: 9706
  Gene Symbol: LOXL2
  Gene Name: lysyl oxidase-like 2
  ENST ID: ENST00000524144
  CDS Start-End: 202-975
cctggacttcaatattgctggtggtggtgcaaactgcaatgcgtaccccagaagggaagctggcagcttaaaagttagcagcgtgtgtgccctttgattcagagagccacttgcgcgtggctctccggagagatttctacctgggtccatgaatggacttacggaaggattccttggtaatgattctgagtgactgtgttgatggaggcaagcaaggtcttggacaagtcaaaggcggcagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagag

SEQ ID NO: 150408 - DNA, 620 bp, Homo sapiens
  Payload ID: 9706
  Gene Symbol: LOXL2
  Gene Name: lysyl oxidase-like 2
  ENST ID: ENST00000520349
  CDS Start-End: 1-620
gcgagaatgggctaccggccgtggtgagttgtgtgcctgggcaggtcttcagccctgacggaccctcaagattccggaaagcgtacaagccagagcaggaccgtgtgtctcttcagcaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccag

SEQ ID NO: 150409 - DNA, 746 bp, Homo sapiens
  Payload ID: 9706
  Gene Symbol: LOXL2
  Gene Name: lysyl oxidase-like 2
  ENST ID: ENST00000524168
  CDS Start-End: 330-746
cagccatcggagaccagagccgccccctctgctcgagaaaggggctcagcggcggcggaagcggagggggaccaccgtggagagcgcggtcccagcccggccactgcggatccctgaaaccaaatggagtctcgctctgtcacccaggctggagtacagtggcacgatcttggctgactgcaagctttgcctcccgggttcaagcgattctcctgcctcaagcctcctgagtaactgggactacagaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacc

SEQ ID NO: 150410 - DNA, 763 bp, Homo sapiens
  Payload ID: 9706
  Gene Symbol: LOXL2
  Gene Name: lysyl oxidase-like 2
  ENST ID: ENST00000519243
  CDS Start-End: 477-763
cggaggccgggcctgctgcggcggccgccttcggggaagggggtgggtccggggaggggtttgccatcctcctctagttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaagttctgaactcccggtctccccagtccctggaggctgcctgcagctttgcttagcttctcagcctgttgatcactgccgtggaattggcgagtatcttccgggggaaagcagagacaaaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgt

SEQ ID NO: 150411 - DNA, 892 bp, Homo sapiens
  Payload ID: 9706
  Gene Symbol: LOXL2
  Gene Name: lysyl oxidase-like 2
  ENST ID: ENST00000520871
  CDS Start-End: 239-892
gaattgccagacttcaagtgctggcagtgatgcggggcctggacttcaatattgctggtggtggtgcaaactgcaatgcgtaccccagaagggaagctggcagcttaaaagttagcagcgtgtgtgccctttgattcagagagccacttgcgcgtggctctccggagagatttctacctgggtccatgaatggacttacggaaggattccttggtaatgattctgagtgactgtgttgatggaggcaagcaaggtcttggacaagtcaaaggcggcagaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagag

SEQ ID NO: 150412 - DNA, 588 bp, Homo sapiens
  Payload ID: 9706
  Gene Symbol: LOXL2
  Gene Name: lysyl oxidase-like 2
  ENST ID: ENST00000518083
  CDS Start-End: 134-588
tatttgtgttgaggggaccagctgttagtctttctgctgctctttctaagaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacgga

SEQ ID NO: 150413 - DNA, 559 bp, Homo sapiens
  Payload ID: 9706
  Gene Symbol: LOXL2
  Gene Name: lysyl oxidase-like 2
  ENST ID: ENST00000523833
  CDS Start-End: 257-559
aaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcacctggtattggcacggagatgtcaacagcaacaaagtggtcatgagtggagtgaagtgctcgggaacggagctgtccctggcgcactgccgccacgacggggaggacgtggcctgcccccagggcgg

SEQ ID NO: 150414 - DNA, 3502 bp, Homo sapiens
  Payload ID: 9707
  Gene Symbol: LOXL3
  Gene Name: lysyl oxidase-like 3
  Uniprot ID: P58215
  ENST ID: ENST00000264094
  CDS Start-End: 73-2334
taggactgatctccaggaccagcactcttctcccagcccttagggtcctgctcggccaaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattcttcagagcccaggagtcagtgctggtggttggagggacctgcccccactggttcatttaaccctctgtctcggtgccctcagaacctcagccagaaaggcaaggaggaaatcagagcaggagcctcatactcttggtgatctattcattctgtgacctcaggggtcacatataaggtcagtgtttctcgtccccgccggatctgcactgccaactgggattgggttcgaacagcttcataaacatcttcagcattttgtaccatctgctccccaatggccaaaatcacatcaccaggccgcagaccagccctatagagaaaaatggacagagagaaaggaaggagtacaaagcctagttcaaggacacatgcacaccttgcccatccccatatcacactgcagcctctccctcaccggtgtgcaggggagcccaggatgactttatggatgagtacaccatgctgaacatcgggaaagcttggttctcgaagctgtagttcagcaaggatgctgaaagtacacagatcaccctattagccaaacccaggcattctccccatcctgagttccacctcaagtctctcatcaacacattgataaatatatggacaggacatgggctaggtactacaaaatacaatggcaactcactttctgtcttctagcaataaagtgcaacatgtacataaaa

SEQ ID NO: 150415 - DNA, 2398 bp, Homo sapiens
  Payload ID: 9707
  Gene Symbol: LOXL3
  Gene Name: lysyl oxidase-like 3
  Uniprot ID: P58215
  ENST ID: ENST00000393937
  CDS Start-End: 96-1922
tttttttttttttttggaagtcctaggactgatctccaggaccagcactcttctcccagcccttagggtcctgctcggccaaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattc

SEQ ID NO: 150416 - DNA, 2005 bp, Homo sapiens
  Payload ID: 9707
  Gene Symbol: LOXL3
  Gene Name: lysyl oxidase-like 3
  ENST ID: ENST00000409986
  CDS Start-End: 99-1859
gcatttttttttttttttggaagtcctaggactgatctccaggaccagcactcttctcccagcccttagggtcctgctcggccaaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtatttgatgggaagagcaacccaggaagattaggggatgggagggaaagacgttcattctcttttccatagcttgtttctccatcttcccaccttcctgtagagctctcagtccctccacttctacccacccttctccacagtgcatctatct

SEQ ID NO: 150417 - DNA, 2897 bp, Homo sapiens
  Payload ID: 9707
  Gene Symbol: LOXL3
  Gene Name: lysyl oxidase-like 3
  ENST ID: ENST00000409549
  CDS Start-End: 451-2544
atactgagtgcttagttctttgcctatcactttctatccgttgtctctctcctctgtgtctttctggttttctctctctcattcccacagtctcccttcctctcacatcctgtctgtctgggtcttcctctctctctacgtgtctcttgctcagtctctatctctttttattgacccttctctgactctcgatctctcatagttgtctcttatctctgggtctctcaggctgtgcctctatgacctgtgcctcagcccttatttaatgtgtttctctccctgtctcttggtccctggggctctttctctcctgttgtctctcgctgtctctgtcttactcagtgtctgtttttctttcgtgacttctccctctctttctgactctgggccccactcaatctgtttctctcacgcacactttgtctctggggcacccaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccagggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttag

SEQ ID NO: 150418 - DNA, 2431 bp, Homo sapiens
  Payload ID: 9707
  Gene Symbol: LOXL3
  Gene Name: lysyl oxidase-like 3
  ENST ID: ENST00000409249
  CDS Start-End: 14-1429
ggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattcttcagagcccaggagtcagtgctggtggttggagggacctgcccccactggttcatttaaccctctgtctcggtgccctcagaacctcagccagaaaggcaaggaggaaatcagagcaggagcctcatactcttggtgatctattcattctgtgacctcaggggtcacatataaggtcagtgtttctcgtccccgccggatctgcactgccaactgggattgggttcgaacagcttcataaacatcttcagcattttgtaccatctgctccccaatggccaaaatcacatcaccaggccgcagaccagccctatagagaaaaatggacagagagaaaggaaggagtacaaagcctagttcaaggacacatgcacaccttgcccatccccatatcacactgcagcctctccctcaccggtgtgcaggggagcccaggatgactttatggatgagtacaccatgctgaacatcgggaaagcttggttctcgaagctgtagttcagcaaggatgctgaaagtacacaga

SEQ ID NO: 150419 - DNA, 1001 bp, Homo sapiens
  Payload ID: 9707
  Gene Symbol: LOXL3
  Gene Name: lysyl oxidase-like 3
  ENST ID: ENST00000413469
  CDS Start-End: 92-1001
cccgggcttctgaggcgtctaccttcccaggtagggctgtacaaggagttctccagcatctccagggcagaaagcttaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcaggggg

SEQ ID NO: 150420 - DNA, 539 bp, Homo sapiens
  Payload ID: 9707
  Gene Symbol: LOXL3
  Gene Name: lysyl oxidase-like 3
  ENST ID: ENST00000420535
  CDS Start-End: 1-539
gcgacaaaggctggagcgcccacaacagccacgtggtctgcgggatgctgggcttccccagcgaaaagagggtcaacgcggccttctacaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctgg

SEQ ID NO: 150421 - DNA, 3653 bp, Homo sapiens
  Payload ID: 9708
  Gene Symbol: LOXL4
  Gene Name: lysyl oxidase-like 4
  Uniprot ID: Q96JB6
  ENST ID: ENST00000260702
  CDS Start-End: 152-2422
ggctggggggccgcgggcgggaggcggataaaaaggccccagggcgcccggggagggagcccgttagcgctgctccgccgcggcgcccgcccagccccggactgtccgcgctccatctggtatcttggcctcagctgtccttgaagtcaccatggcgtggtccccaccagccaccctctttctgttcctgctgctgctaggccagccccctcccagcaggccacagtcactgggcaccactaagctccggctggtgggcccagagagcaagccagaggagggccgcctggaggtgctgcaccagggccagtggggcaccgtgtgtgatgacaactttgctatccaggaggccacagtggcttgccgccagctgggcttcgaagctgccttgacctgggcccacagtgccaagtacggccaaggggagggacccatctggctggacaatgtgcgctgtgtgggcacagagagctccttggaccagtgcgggtctaatggctggggagtcagtgactgcagtcactcagaagacgtaggggtgatatgccacccccggcgccatcgtggctacctttctgaaactgtctccaatgcccttgggccccagggccggcggctggaggaggtgcggctcaagcccatccttgccagtgccaagcagcatagcccagtgaccgagggagccgtggaggtgaagtatgagggccactggcggcaggtgtgtgaccagggctggaccatgaacaacagcagggtggtgtgcgggatgctgggcttccccagcgaggtgcctgtcgacagccactactacaggaaagtctgggatctgaagatgagggaccctaagtctaggctgaagagcctgacgaataagaactccttctggatccaccaggtcacctgcctggggacagagccccacatggccaactgccaggtgcaggtggctccagcccggggcaagctgcggccagcctgcccaggtggcatgcacgctgtggtcagctgtgtggcagggcctcacttccgcccaccgaagacaaagccacaacgcaaagggtcctgggcagaggagccgagggtgcgcctgcgctccggggcccaggtgggcgagggccgggtggaagtgctcatgaaccgccagtggggcacggtctgtgaccacaggtggaacctcatctctgccagtgtcgtgtgtcgtcagctgggctttggctctgctcgggaggccctctttggggcccggctgggccaagggctagggcccatccacctgagtgaggtgcgctgcaggggatatgagcggaccctcagcgactgccctgccctggaagggtcccagaatggttgccaacatgagaatgatgctgctgtcaggtgcaatgtccctaacatgggctttcagaatcaggtgcgcttggctggtgggcgtatccctgaggaggggctattggaggtgcaggtggaggtgaacggggtcccacgctgggggagcgtgtgcagtgaaaactgggggctcaccgaagccatggtggcctgccgacagctcggcctgggttttgccatccatgcctacaaggaaacctggttctggtcggggacgccaagggcccaggaggtggtgatgagtggggtgcgctgctcaggcacagagctggccctgcagcagtgccagaggcacgggccggtgcactgctcccacggtggcgggcgcttcctggctggagtctcctgcatggacagtgcaccagacctggtgatgaacgcccagctagtgcaggagacggcctacttggaggaccgcccgctcagccagctgtattgtgcccacgaggagaactgcctctccaagtctgcggatcacatggactggccctacggataccgccgcctattgcgcttctccacacagatctacaatctgggccggactgactttcgtccaaagactggacgcgatagctgggtttggcaccagtgccacaggcattaccacagcattgaggtcttcacccactacgacctcctcactctcaatggctccaaggtggctgaggggcacaaggccagcttctgtctggaggacacaaactgccccacaggactgcagcggcgctacgcatgtgccaactttggagaacagggagtgactgtaggctgctgggacacctaccggcatgacattgattgccagtgggtggatatcacagatgtgggccccgggaattatatcttccaggtgattgtgaacccccactatgaagtggcagagtcagatttctccaacaatatgctgcagtgccgctgcaagtatgatgggcaccgggtctggctgcacaactgccacacagggaattcatacccagccaatgcagaactctccctggagcaggaacagcgtctcaggaacaacctcatctgaagctgtcactgcacactcctagctgctgccgatacaccagatacctcagcttattggagccatgcccttcacagagtcccaactcagaggaaaagggccagtgccaaggggcaccaagaacctgctcaggaagccttttgatggcaagatcaccaatccagatggtattgctccctcaggatggctctgggcctgcccctaagggcctgtggcctatggaatatgtcctccaggctttgctcagctgagctcctcttctgtaaggaaacccagtcatccctgaatcttgccacagagatccgggattcaggagctctcagtttcttagggatggactatggcccagtcccccatctaagtggtgctttgcaaatgtcttggaggagtataggacagaggaccaaaatacacagcaggtagtgttagctctctgctaggagctcaaagcaacacaacttgtatcaaaatcacaactggcagagaagctggtggatccaatcctttcttcatctgttgttatttagaactcacctctcacactctgttctttagtgtccttacctttatcttaccacacacatgggtgtttctattatccttggaagcacagacctcgggcatccccttattgcctgatgggccaacaccaacagttacggagtgcttgagaaggggcaagtttcacagaaatggccagatagggccttcctacagagcagcaagagtaggccaagcagaaagactgctgaggtaacacggaccccagcccctgtcagggcctctgccaaggaaataatatggaccatttacctggcaggcagtctgctctctctcaggatcaccacgcatctcaggattggtctaaacttcaagtctcaaccaagtgtctgaagtgaactttgcattgaataaatttttgccatggaaagaacatcaaacaagccactcatctctacagagataagaaaacaagtttggcagagcaagagacagaagaccgtggagaaatcagaagggggaacagtcagtttagttaaggatggaacctgggaaaggccaccattcctgcttgatggggctctgatttgctcttgctcaagtggaataaaaccccatggtcttcttgacatgattcttgatcttttctccactgagacacacttaagtgatgatccttacaggactgacaccctaatgccaataaaagttgctcattatggactgctacaaa

SEQ ID NO: 150422 - DNA, 2005 bp, Homo sapiens
  Payload ID: 9709
  Gene Symbol: KARS
  Gene Name: lysyl-tRNA synthetase
  Uniprot ID: Q15046
  ENST ID: ENST00000302445
  CDS Start-End: 41-1834
gtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 150423 - DNA, 2421 bp, Homo sapiens
  Payload ID: 9709
  Gene Symbol: KARS
  Gene Name: lysyl-tRNA synthetase
  Uniprot ID: Q15046
  ENST ID: ENST00000319410
  CDS Start-End: 123-2000
acttttgggtcgggccctccgggaagatggcggccgtgcaggcggccgaggtgaaagtggatggcagcgagccgaaactgagcaagaagtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataagccatttgtctcttctctttacttttagaatatcaacttttttccccagacttctggcctaatgaatgtttaggattttaccatcttattcatttaacaaatttgtattaatgtctgccctgtgccaggcattattctaagagattggggacacagcagggaacaaaagccaagttcctgcttttgtggaaattgtattctttctttggggtagggagaagaagtagacaaacaaaaaaacaagtaaata

SEQ ID NO: 150424 - DNA, 459 bp, Homo sapiens
  Payload ID: 9709
  Gene Symbol: KARS
  Gene Name: lysyl-tRNA synthetase
  ENST ID: ENST00000568378
  CDS Start-End: 82-285
gcggccgaggtgaaagtggatggcagcgagccgaaactgagcaagaagtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaa

SEQ ID NO: 150425 - DNA, 644 bp, Homo sapiens
  Payload ID: 9709
  Gene Symbol: KARS
  Gene Name: lysyl-tRNA synthetase
  ENST ID: ENST00000566772
  CDS Start-End: 1-315
attcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagaggtaaggagagttccttgcctgacgtgatgagctgccttgcaatgcttgcctcctcctctcccttgccttccttttccaaagcgtatcctgtgtcaggatccttcatgcctaatgagaatgtccccttttcttgccatcgtctctgttctaccttgtcctgattaggaaggcaggacctgacttccaagataatggacaaggtatagggccatccacatgctaatgatgtcacattcaatatgtattcacgtcattttgcttttttgtagcattaagaaatattttttgattatatgagaaaggcaaacacacgtaccataaaacaaattcaaacaataaattaaatagaagcaaaa

SEQ ID NO: 150426 - DNA, 1942 bp, Homo sapiens
  Payload ID: 9709
  Gene Symbol: KARS
  Gene Name: lysyl-tRNA synthetase
  ENST ID: ENST00000564578
  CDS Start-End: 106-480
tccgggaagatggcggccgtgcaggcggccgaggtgaaagtggatggcagcgagccgaaactgagcaagaagtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatgtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaag

SEQ ID NO: 150427 - DNA, 801 bp, Homo sapiens
  Payload ID: 9709
  Gene Symbol: KARS
  Gene Name: lysyl-tRNA synthetase
  ENST ID: ENST00000562875
  CDS Start-End: 13-243
ccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaataaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatct

SEQ ID NO: 150428 - DNA, 649 bp, Homo sapiens
  Payload ID: 9709
  Gene Symbol: KARS
  Gene Name: lysyl-tRNA synthetase
  ENST ID: ENST00000566249
  CDS Start-End: 1-259
ggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatgtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctt

SEQ ID NO: 150429 - DNA, 994 bp, Homo sapiens
  Payload ID: 9709
  Gene Symbol: KARS
  Gene Name: lysyl-tRNA synthetase
  ENST ID: ENST00000570215
  CDS Start-End: 227-994
cgggccctccgggaagatggcggccgtgcaggcggccgaggtgaaagtggatggcagcgagccgaaactgagcaagaagtgagtgtcgctgcgagtctttaaagcctttgcggtaggagagtctgggctgggaagcgccgcgaggttcccaccaaggctgctgtgccggggccttcttgccggctctcgtgggtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgc

SEQ ID NO: 150430 - DNA, 870 bp, Homo sapiens
  Payload ID: 9709
  Gene Symbol: KARS
  Gene Name: lysyl-tRNA synthetase
  ENST ID: ENST00000568682
  CDS Start-End: 563-870
cctccgggaagatggcggccgtgcaggcggccgaggtgaaagtggatggcagcgagccgaaactgagcaagaagtgagaagttaattcactcgtccaagtcacataattgacaagtgtgttggaatttagtcccaggcagcctgactacaaagatgtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttaga

SEQ ID NO: 150431 - DNA, 3182 bp, Homo sapiens
  Payload ID: 9710
  Gene Symbol: MB21D1
  Gene Name: Mab-21 domain containing 1
  Uniprot ID: Q8N884
  ENST ID: ENST00000370315
  CDS Start-End: 96-1664
agtagtgcttggtttccaacagctgctgctggctcttcctcttgcggccttttcctgaaacggattcttctttcggggaacagaaagcgccagccatgcagccttggcacggaaaggccatgcagagagcttccgaggccggagccactgcccccaaggcttccgcacggaatgccaggggcgccccgatggatcccaccgagtctccggctgcccccgaggccgccctgcctaaggcgggaaagttcggccccgccaggaagtcgggatcccggcagaaaaagagcgccccggacacccaggagaggccgcccgtccgcgcaactggggcccgcgccaaaaaggcccctcagcgcgcccaggacacgcagccgtctgacgccaccagcgcccctggggcagaggggctggagcctcctgcggctcgggagccggctctttccagggctggttcttgccgccagaggggcgcgcgctgctccacgaagccaagacctccgcccgggccctgggacgtgcccagccccggcctgccggtctcggcccccattctcgtacggagggatgcggcgcctggggcctcgaagctccgggcggttttggagaagttgaagctcagccgcgatgatatctccacggcggcggggatggtgaaaggggttgtggaccacctgctgctcagactgaagtgcgactccgcgttcagaggcgtcgggctgctgaacaccgggagctactatgagcacgtgaagatttctgcacctaatgaatttgatgtcatgtttaaactggaagtccccagaattcaactagaagaatattccaacactcgtgcatattactttgtgaaatttaaaagaaatccgaaagaaaatcctctgagtcagtttttagaaggtgaaatattatcagcttctaagatgctgtcaaagtttaggaaaatcattaaggaagaaattaacgacattaaagatacagatgtcatcatgaagaggaaaagaggagggagccctgctgtaacacttcttattagtgaaaaaatatctgtggatataaccctggctttggaatcaaaaagtagctggcctgctagcacccaagaaggcctgcgcattcaaaactggctttcagcaaaagttaggaagcaactacgactaaagccattttaccttgtacccaagcatgcaaaggaaggaaatggtttccaagaagaaacatggcggctatccttctctcacatcgaaaaggaaattttgaacaatcatggaaaatctaaaacgtgctgtgaaaacaaagaagagaaatgttgcaggaaagattgtttaaaactaatgaaataccttttagaacagctgaaagaaaggtttaaagacaaaaaacatctggataaattctcttcttatcatgtgaaaactgccttctttcacgtatgtacccagaaccctcaagacagtcagtgggaccgcaaagacctgggcctctgctttgataactgcgtgacatactttcttcagtgcctcaggacagaaaaacttgagaattattttattcctgaattcaatctattctctagcaacttaattgacaaaagaagtaaggaatttctgacaaagcaaattgaatatgaaagaaacaatgagtttccagtttttgatgaattttgagattgtatttttagaaagatctaagaactagagtcaccctaaatcctggagaatacaagaaaaatttgaaaaggggccagacgctgtggctcacacctgtaatcccagctctttggaggccgaggcaggcggatcacttgaggtcaggagtttgagaccagcctgaccaacatggtgaaactccatctctactaaaaatataaaaattagccgggcatggtgatgcatgcctgtaatcccagctactcgggaggcttagacatgagaatcacttgaacccaggaggtggaggttgcagtgagtcaagatggcaccactgcactccatcctgggtgacagagcaagacttcctctcaaaaaataaataaataaataagaaaaataaattaggaaattattaaaataattttttagaaaagcaacaaaataacaaaaattagtgactgtaataattggaatgtttgaaatttgtcacagcaataattgactaaaatgaatgtaaataattattcagttttcagtttgttgtaataaactctaatcagtataaaggattgactatcctaggaaaaagattagtcaaggaataagaagcaaaagtagtatttgaaatctaaaaacattaccatgtttgctttatcatgcaggcaaataaataaataaatgacatttttaggttggaataaaaaaagataaagtacatattgccttaattaaattcatcaagttcttactgaaaaacagctctccgccgtgcctggccaggaaatacataattttttttttttttttttagatggagtctcgctctgtcgcccaggctggagtccagtggcatgatcttggctcactgcaagctctgcttcctgggttcatgccattctcctgcctcagccttccgagtagctgggactacaggtgcccgccaccacatccggctaattttttgtatttttagtaaagatggggtttcaccatgttagccaggatggtctcgatctccttaccttgtgatccgcccgccttggcctcccaaagtgctgggattacaggtgtgagccaccacgcctggctgaaatacataatcttaaaagaaaacataagatactttattttaatatacgtgactaaatgtaaaacctaacttattttctgttatctatttatttttactttcagtaacactttttttattttaggtagcattcagcctagaggcaactgctgtttgttaaatatttcctgttcatatattttgcacattttcttatgggttagttttcttctcattgttttgggaagttcttaatatatttggggtatttatctttcattcgttgtctgtgtaacaaataacttctgccatatgggttgtctgcacattttttggtgtcttttagtaaacaaggtttttttgttttgtattgttttgtttattgtaaagatttttaaattttaatggagttgatttcttttctcattcaagcttttgagaataaattggagttgaatttttta

SEQ ID NO: 150432 - DNA, 1917 bp, Homo sapiens
  Payload ID: 9710
  Gene Symbol: MB21D1
  Gene Name: Mab-21 domain containing 1
  Uniprot ID: Q8N884
  ENST ID: ENST00000370318
  CDS Start-End: 79-1422
aacagctgctgctggctcttcctcttgcggccttttcctgaaacggattcttctttcggggaacagaaagcgccagccatgcagccttggcacggaaaggccatgcagagagcttccgaggccggagccactgcccccaaggcttccgcacggaatgccaggggcgccccgatggatcccaccgagtctccggctgcccccgaggccgccctgcctaaggcgggaaagttcggccccgccaggaagtcgggatcccggcagaaaaagagcgccccggacacccaggagaggccgcccgtccgcgcaactggggcccgcgccaaaaaggcccctcagcgcgcccaggacacgcagccgtctgacgccaccagcgcccctggggcagaggggctggagcctcctgcggctcgggagccggctctttccagggctggttcttgccgccagaggggcgcgcgctgctccacgaagccaagacctccgcccgggccctgggacgtgcccagccccggcctgccggtctcggcccccattctcgtacggagggatgcggcgcctggggcctcgaagctccgggcggttttggagaagttgaagctcagccgcgatgatatctccacggcggcggggatggtgaaaggggttgtggaccacctgctgctcagactgaagtgcgactccgcgttcagaggcgtcgggctgctgaacaccgggagctactatgagcacgtgaagatttctgcacctaatgaatttgatgtcatgtttaaactggaagtccccagaattcaactagaagaatattccaacactcgtgcatattactttgtgaaatttaaaagaaatccgaaagaaaatcctctgagtcagtttttagaaggtgaaatattatcagcttctaagatgctgtcaaagtttaggaaaatcattaaggaagaaattaacgacattaaagatacagatgtcatcatgaagaggaaaagaggagggagccctgctgtaacacttcttattagtgaaaaaatatctgtggatataaccctggctttggaatcaaaaagtagctggcctgctagcacccaagaaggcctgcgcattcaaaactggctttcagcaaaagttaggaagcaactacgactaaagccattttaccttgtacccaagcatgcaaaggaaggaaatggtttccaagaagaaacatggcggctatccttctctcacatcgaaaaggaaattttgaacaatcatggaaaatctaaaacgtgctgtgaaaacaaagaagagaaatgttgcaggaaagattgtttaaaactaatgaaataccttttagaacagctgaaagaaaggtttaaagacaaaaaacatctggataaattctcttcttatcatgtgaaaactgccttctttcacagactctactgatatatttccaagtattaggtcacttgataagtgatccgcactgaagcaaaagataaactcagcattcttaggtgcttattctaatgccaccagttttacttctgttagcaaaaatctaaagtaacataacagacttatcacccccatttggaattagtatacaaatagaaatgatcctaatcaatttaattaattataatggacacacaagaaaaaatacctacacagcttttcgagaaacgaagacaatgactttgtctgtggatgacatactctgtagaaaagtttgcatgtgactccatttctcttcctcggtggttacaattatattttgcttcactgaacttacagcctaaaggattcaaagaacatagttcatcaaggtcatcatgattgagggtgagaccgcatacatcagctcaaaatgcatcttctctctcattggttaatgtttttaataaactgctaagcaaaatggcagacgtcctaaaaaaa

SEQ ID NO: 150433 - DNA, 3368 bp, Homo sapiens
  Payload ID: 9711
  Gene Symbol: MB21D2
  Gene Name: Mab-21 domain containing 2
  Uniprot ID: Q8IYB1
  ENST ID: ENST00000392452
  CDS Start-End: 322-1797
agttggctctacgaccgccgttgccgctgccagagagggccagggcagggcagggacgcgcagcatcggggcgggcgtggggccggagaaaagggtgtcggggccacacacgcaccctcgctgcagtccagctcctcccgaagctcgcacgcccagagcgcacggagcgggggactgcccgcccagacgcccgcccgccaacccgcccacgagccggggccaaagcctgggagcctgcgaggggaggaggcccaggggggcggggtggggggcgggggtgggtgccgcgctgccgcggagctgctactcggcgcgttttgcatgaagatggcggctcccaccgccaacaaggcagcctccctgggctgtaacaacaagcctgcgttcccggagctggatttcaggtcgggagctcgggtggaggaattgaacaaactcatccaagaatttacgaagcacgaccagcgggaatacgacgaccagagagcgctggagattcacacagccaaggatttcatcttttccatgctgggaatggtgcaaaagctggaccaaaagcttccagtggctaatgaatacctgttgctctctggaggtgtccgggaaggcgtggtggacctggacttagatgagcttaatgtctatgcccggggtactgactatgatatggactttaccctcttggtgccagccctcaagctgcatgaccgtaatcagcctgtgacactcgacatgcgccactcagccttgtgccactcttggctgagccttcggctctttgatgaggggacaatcagtaaatggaaagactgctgcaccattgtagatcacatcaatggtgccaccaactacttcttctcacctaccaaagtggctgactggttctatgactctatcagcattgtcctatcagaaatacagaagaaaccccagcgagggatgccaaaggtagaaaaggtggaaaaaaatgggaccatcatctccatcattctgggtgtagggagtagtcgcatgttgtatgatattgtccctgtggtatctttcaaaggttggcctgcagtggcccagagctggctcatggagaaccacttttgggatgggaagattactgaggaagaggtcatcagtgggttttacttggtgcctgcttgctcctacaagggtaagaaggacaatgaatggcggctgtcctttgccaggagcgaggtgcagttgaagaagtgcatctccagcagcctcatgcaggcctatcaggcctgcaaagccatcatcattaaactgctgtcccggcccaaggctattagcccctatcacctgcggagcatgatgctctgggcctgcgacagacttcctgccaactacttggctcaagaagactatgcagcccactttttgctgggcctcatcgatgacctgcaacactgtctggtcaacaagatgtgccccaattatttcatccctcagtgcaacatgctggaacatctgtctgaggagacagtcatgcttcacgcccggaagctgtcctctgtgcgctcagacccggcagagcacttgcgcaccgccattgagcatgtcaaggcagccaaccggctgacactggagctccagaggcgaggtagcaccaccagcatcccctctccacagtctgacggaggggaccccaaccagcctgatgaccgtttggcaaaaaaactgcagcagctagtgactgagaacccgggaaagtcaatctctgtctttatcaatcctgacgatgtcacaaggccccatttcagaattgatgacaaatttttctgagtgttagctgacttttttttttcctgattcttaaactctgataatgtgtcgtgtggtttgtgatgctatctttctgttttttacatatccagcctagattggatttgttaagaacaaattttaagtttcctggttctgcaggatggtgcaggctctgaaacagtatattactatttcatattctgcctctgatttcgttgtttactttttgtagttattgtcatgctctttagtttgttggagttttttttctttttaaggagatcttaagccatagatgaaaatgcccatgaatcctcttgcttttttctgtttcatacttggtgcaaatttgttcatgggtatggggaaacaaatctctttctgatgcttaacgattctatcctattatttttattattttgtttttgtcttttttcttatgagctttcaccactactgatatttgagaatcatatgaacctgggaactacttggcatgttagctggatttatttattttggccagtgaccagagtagtttccccccttttccaccaaacaatgtaaactttgaaagtgataatactacaaattgtgttttggagcaacttcattgaatgtaattgtcctcaaatcagagaacactgggtggtttgaagggtgtctttgacagttttccaagcagaattaaggtttccaaatgttaattttagcatatgtaattatttgaagccttatttaaatcctattaaagaacataccattataattattatttgcactaatctttgccattgtcagaattgcaaagtgtgtttcaatataaattaacaaccactctcgaaattctatcattttttcattttgcccatttctatcagtgaaatgattctttgcatttgcttagttctccttcagttgtggggtcctgctttgccctctttgatattcctggttcctgtcttactgagagaagttgttaaagctttatacatgttgaccccatctaaagctggggaaaatatacacttgatgaagtaggtgtctttgtatttatttcttttggggtcatagaggtaagcttttttgtaaaatctctactcttcctgagagttttgagaaaaactggcaggaagaacttataatccccaaatagaagataccacgtctgttcaaaagcaggtattgctatagagcagcacccaggaaatatctgtgggtggcagccttggtatagaggtgtcctgtcttcatgagtgaagttacttgcctgattaggtgctggaaggtattggctccctgttttggtgtggactcatggcaagctggtgtttaagaggtcaggaggcctgctgatctttcaaaggacacccatgatgtctactcatagaaagggcaagtaacgtgttcattttggtcttgaatgtccaaactcaagggttggattttggccaattgaaatcagacatatgcgatcttgggtttttgcatggaaattaatgtaatgcttataaatgaaaaatgaaaacatttcaaccatctaagtcaaacacaaaaataataaaaaaagaaacatactggccttgaaa

SEQ ID NO: 150434 - DNA, 3028 bp, Homo sapiens
  Payload ID: 9712
  Gene Symbol: MAB21L1
  Gene Name: mab-21-like 1 (C. elegans)
  Uniprot ID: Q13394
  ENST ID: ENST00000379919
  CDS Start-End: 1072-2151
tacacaggtactcctccatctaaagccaacttccatatgccagtagtctgcatgaaagaacaaactttcaacctgcatttaagaagaccccaaggattaacagacgttaattatcttactctaaatgcaagttagtgattttgttttagaaaaccccgtcaagatcactaattgatggatgcccattaatacacctgtatttgcatttcagcggtaaaagacaagcaggttttcggcacagaagagagccgctttgccaagtcttttcaaaacgtcaatatgcttcaagtaataccaaagctgagagattcctcttgatttccaaactgtctaggtggcctgagtggttttccgccggcagcagcctcctacctttagtttgtgtgcctatatccatgagtggggattaattagccgggttggagctgaaggaggctgtcgtgacgagcccagtggcgattggccgcccgcctgcctggccctgcctttataatttccacacgagtgcatctgggctcttagacaaaccaacagcagcttcttctgacatatacacacgcacactcaccccggacacacactcagcacacttttcctccatttgattaacagtgctgcacacacaatgattacgggaaagcgcaaataaatacggaaaggggtgcttattttgactactggaagagctttgctgggtctcagcgcaacttttgttttttattcctgagaaggtgatctctccatgcggttctctcacacaaggattctttaaaagaggaagagagacaagcagaggggggaggacagtctttcactttaagaacggctgggctcaaagataaaaggaagggaaaagcagcagcagcagcagcagcagcagcagcagcagcagcagcagcagcagcagcagcagggaaaccaacgctgcagcacttccgaaaggcatttttgatccatttctgagtgttgcggcccgtttctccaccgaagttggctccagctctagcagccgcattggatcccacagcttactgcgagactccggtgtacaatccggatctctgccccaacatgattgcggcccaggccaagctggtctaccatctgaataaatactacaacgaaaaatgccaagccaggaaagctgccattgccaaaactatccgggaagtctgcaaagtagtttccgacgtactgaaggaagtggaagtgcaggagccgcggttcatcagctctctcaacgagatggacaatcgctacgagggcctcgaggtcatctcccccaccgaatttgaagtggtgctttatctcaaccaaatgggggtgttcaacttcgtggacgatggctcactgcccggctgcgcggtgctgaagttgagcgacgggcgcaagaggagcatgtccctctgggtggaattcattaccgcctccggctacctctcggcgcgcaaaatccggtccaggtttcagacgctggtggctcaagcggtagacaaatgtagctaccgggatgtggtaaagatggtggcagacaccagcgaagtgaaactgagaatccgagataggtacgtggtgcagatcacgccggcctttaaatgcaccgggatctggccgaggagtgctgcccactggccacttccccacatcccctggccgggacccaaccgggtggcggaggtcaaggcggaaggtttcaatctcttgtccaaggagtgccactccttggccggcaagcagagctcggcggagagcgacgcctgggtgctgcagttcgcggaggcagagaacagactgcagatggggggctgcagaaagaagtgcctctccatcctcaaaaccttaagggatcgtcaccttgaactgccgggccagcccttgaacaattaccatatgaagactctggtttcctacgagtgtgaaaagcatccccgagagtcggactgggacgagtcttgcctgggtgatcggctgaacgggattttgctgcaacttatctcctgcctgcagtgccggcggtgtccccactactttctaccgaacttagatctgtttcaaggcaaacctcactcagctctggaaaacgctgccaaacaaacgtggcgactggcaagagagatcctgaccaacccgaaaagtttggaaaaactttagaggatgatttaatcaagagccgaaattattacccttctcaaagtccttattaagtgtaaacttctgttcaattcctaatattccactccgcagtgcaaacaatctcttcctttaaaaaggaataataatacaatatttaaacatcatctcacccacccccacaaggggagaaaaagtaggggaagcggatggagaaaaacccaaagccactagtattagaagacttctttccacacgatttcctatctcccttgaaaagtacaccgtaacactccgtaaacagcccagctgtaacgccagaccgagacgaacactctgcctaactatcaaaggattatagcaatcctggtgatttaggtgcatctgtctgtgagtaaacacgatttggatatgccatctgaaagaaactgtaatgtatattttgatttgtaacaaatattgtgatctcacattgtctttgaaagtgtggatgttggtgttttgtgatttggtgaacagaacttaaattgccattctggatacttccagacattttccactaacaaagatatcatttaaaggtagatttcttcctggtacttttatctgtctttgaaagtgtctgaactttaaaaagtttacattttgtttcaaatattgcttgttctatttctaacattccataaatatacttgaaatgttatttaaatatattcaaagaaatttgaattcagcttatataataacgcttgaatatctgaattatatatttgaaaaatgcacttgaaatacactggataattacttttgtgatttagattttaatttgttgctggtttttatttaattagatggtaataaatgaagtaaaataaaagttgttgtgtctcactttaaa

SEQ ID NO: 150435 - DNA, 2772 bp, Homo sapiens
  Payload ID: 9713
  Gene Symbol: MAB21L2
  Gene Name: mab-21-like 2 (C. elegans)
  Uniprot ID: Q9Y586
  ENST ID: ENST00000317605
  CDS Start-End: 1109-2188
gagggagagagagaaagaaagagagagggagagagagagacagagagagttagaggaaagaagagagagcgagcacgaggaaggggggcgggggagagaagcagggggagagcggggcgagaaagaggtcggaggggagaggagggggagagacgactcagaaagtggaatctgtaaaagcaagctagaggagaagaaggaaaaccctgaatcgttataactacaccccagatgcaacgcaagcaacgacttcgtcacactaaaacggattttgtgagggccaaaagtataaattacgaagcagaaatgattatcaaacaacttccagcggtttgcacctaaagaaacacaaggagaacccactacaaacaaacaaacccagtccaaacaacgcctccagtaggaaaagaggaaaactgcgataacacgaccccccgagaagagacgagaccaacacgctgagactgtggggcgtcagcaaacctccaagtgcacggcggactgagttgtacttcgcagctctctggacattaattacctcctgcaccttccatttgggggagggtgaggaagaaggcactcacctacactgagcgaagaagtcctatcagcgtggaagagaagtttaagaatgaaccactgaatgtttcgcttttatttttaaatttactttggcacttaaaaaacctcatttccagatttctggacaatctcggctgcagacatctaagcctaaccttttggtatcctgagttttttccctctccttctccttcctcacgcccaccccgcttctctcgcacacggtcatctttacatatcaagagaaagcaaaaaggttccaagaggtacttttctttttagaaaatcaccttttctcccctaattcttctgcagaagaaaagaggtttcgaaagagggaaaaggaaaaaacaagccggctacggtatcagccggtcagcccaggtggaaaacgagagtgaaagtagggcttaacggggagcgcaccgcctctttcgaaagccgctgggccaccaccagtgcgtgagccttggatccctcaacgtattgcgagacgccggtgtatagcccggacctgtgccccaacatgatcgccgctcaggccaagctggtttaccagctcaataagtactacactgagcgctgtcaggcgcgcaaggcggccatcgccaaaaccatccgagaggtctgtaaggtggtctcggacgtgctcaaggaagtggaggtgcaggagcctcgcttcatcagctccttgagcgagatcgatgcccgctacgaggggctcgaggtcatttcgcccaccgaatttgaggtggtgctctacctaaaccagatgggcgtcttcaacttcgtggacgacggctcgctgcccggctgcgcagtgctcaaactgagcgatgggcggaagcggagcatgtctctctgggtcgagttcatcacggcgtcgggctatctctcagcgcgtaagatccgctcgcgtttccagacgctggtggcccaggcggtggacaagtgcagctatcgggatgtggtcaagatgatcgcggacaccagcgaggtcaagttgcgcatcagggagcgctatgtggtgcaaatcactccggcgttcaagtgcaccgggatctggcctcgcagcgcggcacagtggcctatgccccacatcccttggcccggccccaatcgggtggccgaggtcaaggccgaagggttcaacttgctctcgaaggagtgctactcgctgaccggcaagcagagctcggcagagagcgacgcctgggtgctacagttcggggaggcggagaaccgcctgctgatgggcggctgccgaaacaagtgcctctcagtgctgaagactctgcgggaccgccacctggagctacccggccagccgctcaacaactaccacatgaagacgctgctgctgtacgagtgcgagaaacacccacgagaaacggactgggacgagtcgtgcctgggcgaccggctcaacggcatcctgctgcagctcatctcctgcctgcagtgccgccgctgccctcactactttctgcccaacctcgacctctttcagggcaagccccattcggccctggagagcgctgccaagcagacctggaggttggccagggaaattctcaccaatcccaaaagcctggacaaactatagggtgctggggactgcttgaaaagcgacacaaacgggcgtgctctctcagacacacaactctgctataaacagcagaaactctggacacaaacttttatgtaagtcacctgaaataggaatccggcagaagaccttcattaattaagaagcaaacaaaaagagagcaacccaaccaaaacaaatcacattcttgcacaaaagtgatcgttttcttccaaacaatgtgaatttaaaaggtcacacaaaagaagcaatcgggctccgccaccacaaaatgaaacccaaggtacattttcaaatcaatgtatagtagttccccccccttttccttctttccccctatcctttttctctccaccccatccccccccccatttcgttttgcttttggttgcctgaatgttgtcaccaagtgaaaaaattatttaactatatgtaaaatttctcttttaaaaaaaagttttactgatgttaaacgttctcagtgccaatgtcagactgtgctcctccctctcctgaacctctaccctcaccctgagctgtcttgttgaaaacagtaataaaaacattactttacattgtaa

SEQ ID NO: 150436 - DNA, 3229 bp, Homo sapiens
  Payload ID: 9714
  Gene Symbol: MAB21L3
  Gene Name: mab-21-like 3 (C. elegans)
  Uniprot ID: Q8N8X9
  ENST ID: ENST00000369500
  CDS Start-End: 266-1354
atttttactgccagctttcaagttggaagagggaaattacgtttaaaggtcagcagatgacagatggattttcacaatttggaaataaaaacatgagtgaagggttcggaaggcaagtctctggtccattacacacttccagaaaaacttagtacccagagactcacattactgggagtgctatctactcacaagtgttgcactccattgagaaaaaaaaaaaaaccaggaagttgctgttctactgaggactgaccaagaagccatgaaataccttactgtgggagacttagaagattgcctactgaataaggtggacttgaggcgccagcagatttcccaggctgtggaggaggtgcagaaagtcgttcatcatttgaccacaaacatcagcaaccaagacattagatttcaagctgtgccttactctgacacgtacaatgaaaatattaaggttttggctcccagtcagttcctcgtcacagtcccaataaaaggcctggccgggtacagggaggccagggagcagcactggcggtactacacactgcagggcaccaggctgccctgcccgttgcgggaccctgagggtctgcagcagtggctggaggtggaacagtttatgaagagcctgtggcagtggcatgagacagatgtgaacatcgacggagacattgtgcctgccaaggtcctcctagtgttccggaagctggtggaaaatgcagttagaacctgtcacctctcaggtaaggtcagcctgctaggaaaccgctctgcagtttgggttgctgtggaaacatctgcatatcaggtggaactggagctggtccccgcagtggagatccccaccacctggtccaagaaagcccggtggcctcgatgtctgcagcgctggccttcccaagagagagtggagtgcatcaagtcgtttggatttaacttgttggcctgttcaaattatcactggcagctgagcttcctccgtgctgagcaggtgttactggaacagctggatgaagatgggggctgccgtaggaagtgttttcaggtcatgaggcacctgaaggaggacatctggtgcccagggaacaggccggttatcacgtcccaccatctgcagactgtgctcttttggacctgcgagaaatatccccactttaaagactggcaggtcttcagcaaagcatttctgcgcctggtgaggaaactgcacaagtgcgtgagccagcacttcctgaaacactatttcgtccggaacagcaacctctttcagtgcaccaacccgactgaactggacactgtggcccaaaagctggccaccttcctgaagaacccccagatcggcccgccctgatggttgccccggcctgggaggctcttggacattttattctggcttaacattgttctttggatggttcctcagtcaggtgccaggatcctgcctaggagaaaggccacgaatggcagcggaaattacatcaaaccagaaacacttcagcagggggaaaactgtgccccaggatgtctggcccaggcctccctggagcccagcaagcatttctgccctagctaattctcctggagacagctctcatcaggcttccccaggcacagatttggaactggtgacagttctgaacttagtttcccttgttcaggctgtgatcgtctcacagtgaagatggagacagaacccctggaagtctggacatgagcctgctggccaatactgtgcccagcccactgatcatgggcacattctcctgccatttgtaaaatgggaatgttaacgtgcctacctctgagcagggctgtgtgcctatgaaactgtgctggcgccttttcaaggggaaggcattggatcaacacaaagtgttcctggttggttgagtagctggtgtttgcatcctggatcggtacccacagcactgacgcaaaattgcacctgatgagttagtgagcctgtgcttccttgctgccctccagcttccttagcatgtgggtcagtggctcctgatgttctgtctgcttcgctggtattctctaagcagggaggggaatggttttgatgataagtgtaagtcaaagatgaaagtacaactcttggcctgatcccaaccatagccctctctttgcttcccatgccatgggccatggatggaacttccttatatatttatgtaaataacctagtactatgatctgcatggagtgaccttaggtgtctgtcactgctcagtgtgttcctttgctcacttcattcactcactcactcattgacaaataatgctcattaggcaccgggaacacagcaaagagcaaagtggatgaggacctccccctggggatgccacctaatggtggagacaagaaatgaacgacagataaacacgcacagttattacagatggaagcaagtgcttcaaaggaaataaacagaatgttgaagtagagtccacagaaaggtccccgaaggatgaaaatgcaaatagctgaaggggaaggaaaagtgaccaaaggcaggcatggtggggctggcatgagtcagagcacctggccttgtaaagccaggaaggaatcagtattttattctaagatcaaaggtgtgacatttggcctctccagaagcagaagagtatcacgatctgactgcattttaaacaattgttctggtaactgcatgaagaaggtctggggactcacacaggagctgggcactgagtgctcttgagccacccatttggaatttcacagaggcccacaaggcaacatattctgtgtggcacaaccgatcaggaattctaggagttctcggtgagatcaatggtttttttctggcgtttatgtaatgcttctcaactcaaggggctcctttattacttttgaatgtttttgcccaaatgtctataccaaagataaatttctaaagcatgaactactgattttgttttcatgaaaattcacatttgaaaatgaaaatgattacttttcaaaagtactgtaaacggcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatagatccaggagctggttttttgaaaggatcaacaaaattgatagactgctagcaagactaat

SEQ ID NO: 150437 - DNA, 1205 bp, Homo sapiens
  Payload ID: 9715
  Gene Symbol: MACROD1
  Gene Name: MACRO domain containing 1
  Uniprot ID: Q9BQ69
  ENST ID: ENST00000255681
  CDS Start-End: 68-1045
gagagacactcccgagcgccgtaaatagagtccaagtgggcggagagccgtcccgcgccgcccgctcatgtctctacagagccgactgtccggccgcctggcacagctgcgcgcggcggggcagctgctcgtccccccgcgcccccggcccggacacttggcgggtgccacgaggacccgcagcagcacgtgcggtcccccggcgttcctgggcgtgttcggccgccgtgcgcggacctcggcgggagttggggcgtggggggcggcggcggtggggcggacagccggggtgcgcacttgggcccccctggccatggcggcgaaggtggacctgagcacctccaccgactggaaggaggcgaaatcctttctgaagggcctgagtgacaagcagcgggaggaacattacttctgcaaggactttgtcaggctgaagaagatcccgacatggaaggagatggcgaaaggggtggctgtgaaggtggaggagcccaggtataaaaaggacaagcagctcaatgagaaaatctccctgctccgcagcgacatcaccaagctggaggtggacgccatcgtcaacgccgccaacagctccctgctcggaggcggtggcgtggacggctgcattcatcgggccgccggccccctgcttaccgacgagtgccggaccctgcagagctgtaagactggcaaggccaagatcaccggcggctatcggctcccggccaagtacgtcatccacacagtggggcccatcgcctacggggagcccagcgccagtcaggctgccgagctccgcagctgctacctgagcagtctggacctgctgctggagcaccggctccgctcggtggcgttcccctgcatctccaccggcgtgtttggctacccctgtgaggcggccgccgagatcgtgctggccacgctgcgagagtggctggagcagcacaaggacaaggtggaccggctgatcatctgcgtgttcctcgagaaggacgaggacatctaccggagccggctcccccactacttccccgtggcctgaggctcccgcagcccaccctgaccgggactgacccgccttcgggaccccgctcccagctctgagaggtcgccaaagcctgcagcctggcctgggcctggccaccccttctttccctccgcgccccgcccccgaggagcctaataaagatctcgttgtggca

SEQ ID NO: 150438 - DNA, 4994 bp, Homo sapiens
  Payload ID: 9716
  Gene Symbol: MACROD2
  Gene Name: MACRO domain containing 2
  Uniprot ID: A1Z1Q3
  ENST ID: ENST00000217246
  CDS Start-End: 396-1673
gcgtgcgccctggggcccaagttggggcgcgccgtggctagaacacggagagcggcgggcagtgcagccaatgggaggcggcgctgcctagcggctggtaggcggtgcctgcgcgggtgttaggttagcgcgaggcgtgacctagttgacaggctctgaggtgctgctgtggcggcgtccgcggggctgaggcgggtgggagccggagccgagcgcgggctgagggaggagggcggcgactggagagcggcgagcggcgagcagcgcaggacgcagagcctctttcactttttccctgctgagtgccccctcccacccctcccactccacacacaccctgtttgcccgtgagcctggggaacttgcagcttaaagccagccacccccacggcaacatgtaccccagcaacaagaagaaaaaggtgtggagagaggagaaagaacgtttattgaagatgaccttagaagagagacgcaaagaatacctaagagactatattcccctgaacagcattctatcatggaaggaggagatgaagggcaagggccaaaatgatgaagaaaatactcaggaaacatcccaggtgaagaaaagtttgactgaaaaagtttctctctatagaggtgacatcacattgctagaggtagatgctatagtcaatgccgcaaatgccagtcttcttggaggaggaggtgtggatggctgtattcatagagcagccggcccctgtttgctagctgaatgtcgtaacctgaatggctgtgatactggacatgcaaaaatcacatgtggctatgaccttcctgcaaaatatgtcatccatactgtagggccaatagccaggggccatattaatggttcccacaaggaagaccttgcaaattgctataaatcatctctgaagctcgtgaaagaaaataacatccgatcagttgcatttccctgcatctcaacaggcatttatggctttcccaacgagcctgctgcagtcattgccctcaacaccattaaggaatggcttgccaagaatcaccatgaggtggatcggatcattttctgtgtcttcttagaagttgacttcaaaatctacaaaaagaaaatgaatgagtttttctccgtagacgataataatgaagaagaagaggatgttgaaatgaaagaagattcagatgagaacggtccagaggagaagcaaagtgtggaagaaatggaagagcagagccaagatgcagatggtgtcaacactgtcactgtgcccggccctgcttcagaagaggcagttgaagactgtaaagatgaagattttgcaaaggatgaaaatattacaaaaggcggtgaagtgacagatcattctgtgcgtgaccaagatcatcccgatggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgcaggggcacaagatgaagcgaaggaacaaagaaatggaactaaatgacaatcctcagcatcgcaaggcctctcctggctctgggggagctcgggaagatagcagcacacgctgtggaggagggtgggggtggggggaaggcaagtcccatggaaggacggggaatcctttactctaatttctccagctgcattttgttccgtttatctgcagaaaaagaaagaaaaaaaagaaaaaaaaagtttcctttaatttggtggagggacccatgttgacgcatctttcaggcattatccttgtaatttctgtcttttctcttacaactttgccccagggtcacagtggcttgattgaacactcacatgtgtatcctggcccctgtctgctttcttggttatttcacaaagctggtcacacagtggtttattcaaaggaaggggaggaagacagtggtttgataagctgcaggataaattttaggaatcaatgagcccagcagcagtataatccccagacagaggaggcaggatagaaaatgggcaaaagcctcggaaaccacttggaaaaggtctggacaatgaggtgaaaatattttcttcagggttcccaaggcacaatttgttccaagtggctaatgagaaatatggaagctgaattttttccagagcagagtgcagaggcataacagaagggtgggccctggcagccatctgggtctcttccttcctaaccatggtggcaggtgcatccttctttgacactgactttcagcagagcttacttggttcatgaggtcttcacatggagactaccagcaagaggtgactctctgctgcataactgtaaaggatggccctttgctaggtgttacagttaaaagctaagaaaaggggcagtgcatttaggacccaaacatatgcctatgaatatcaaaagctcctcctgaaattgctgtgagttttccataaaagaatatcctgtcttcacccaaggcttgacagcccacagagtggtctcatttgaaattacaggaaattagagcttttgcttgcagttctgccttcctggcctgtgtttaaatgctgtcacttgtttatgccaagttcaaggctgattcaatggttggtcccctcacccagaaaaccctgaaggggaggatacagctctgaaggggggcagcagtactaaaaacccaagatgccagtggtatagtgggcacaagggatggcgaccatgaggatgccaggcatcatcaccaatatctatcctagagccagtataaggccagatgcctacttcccacagcctccccgggttccaaagtcatgtcattgttttcagtggaaacatatcgtttgttgcatatcttcttaaatccatcttccttgtaagggctttagaactaaaacttacttatattgtttttccttaacagagggagaaaaatagtggattattatttctaaaataaaaggatgttctgctttctaaatatcccatcaaaatcttcagttttgcacttttttgatggaaaattcatcttatcttcctatgactttggttttagcctttctgaatttgttaccccttctggatggcttatttgatatactggaatagttaacaagctatacttcagcatatgcactatattctaacaaattttttttaataaaatcaagacatcagcaagaatgacatttacgtgacctcataatgtgggattatggccttctgttgctattccagtttgatatggaagcatctatatcctctattgccgttagatgttgttgcttttcagaaaagtaacgaaaaggctcattttaaagaatccaagaaacgatgtcatccaaatattgacagtttctacatttcatgccatctttataactcaattgaaagttgccgtcattcttgtgaagtatttgacaagtgcaatctgctagaagctcgtttttcttgtgactcccaaatgttagtgctacttagcctcagtaatgagttacagttgaaaaaaacatgagggaaacagagggacagagattttctaatgaacaatgatggaagagacctaatgtccttgctagaaacagccaggatggaaattatccagccctggcattctccttatcatcaatgacagtcattttattcatttatttcaaatgtgggtgggctagaagtggaaggagggaattctctctgcctaaaaattctagaagaatgaaagtaatctttgtatccaggaaactaagagaatgaggaataaatatcttcagcccgactcctgaatttgtttattcttccatctataattagattgtgttttcatttttgctttgtcatgctttttggttgttatttggctatacagttttatgctttaaaacaaatgataaagttaatttccaattcaatagtgaaatattaacaatctaactatagccagatcaaagacacctgaacacagaaaacctttatttgctggtgctgccattgcacaggctgtacaatgaaatagatttgaaaagctgattgattttcccgcacataaattctggatgtcaatttccaaccaaactccaatacagctatgtggcatgaagagttacaggagggagggaggaaaatagccctatgttagtcatgtttgcatacagaggatcaaagtaggccttcaccataatagttctaattaaaatggtcctcgctgtaggagagacaaaggggcttttcctctagctggtaactattcagatgatggacaagtcttctttcataaaagattacaaagaaggcatccgaatcactgtctgtgatactgggtcacatattaatcactgcagctaattgtaaatctttctatgaaacactgaaaagcctctttgtgaattaatacagttctgcttgatgcacttgatttgaaaagacatttctctgtatgtggcgcatgtcggctttgctttgaaaaataacaaagttagcagaatatgttcaatatattttcttggggaatagggtttttattacatgattcattaaggatttgccttaccctgacatttgtgatataaaggaaaatcagaaaaaaagtaattttcttgatcaagatatgtttttacttaatgcaaataaatgtagtctgttgcttgcaaggaaaaaaaaatggcttctgatatctggtataaactgctaaataggataatacgtgcctcttttgttaaaccggcatttaaatgctggactgcttctaaatctgtttgtttcttttcatctgtgccatacactaaaaaacaactgttgccttcatactatatttgttagagcagaatacaaataaaatttgtttgagaggataatgtgaaa

SEQ ID NO: 150439 - DNA, 4025 bp, Homo sapiens
  Payload ID: 9716
  Gene Symbol: MACROD2
  Gene Name: MACRO domain containing 2
  Uniprot ID: A1Z1Q3
  ENST ID: ENST00000378058
  CDS Start-End: 63-704
aggtggatcggatcattttctgtgtcttcttagaagttgacttcaaaatctacaaaaagaaaatgaatgagtttttctccgtagacgataataatgaagaagaagaggatgttgaaatgaaagaagattcagatgagaacggtccagaggagaagcaaagtgtggaagaaatggaagagcagagccaagatgcagatggtgtcaacactgtcactgtgcccggccctgcttcagaagaggcagttgaagactgtaaagatgaagattttgcaaaggatgaaaatattacaaaaggcggtgaagtgacagatcattctgtgcgtgaccaagatcatcccgatggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgttgaaatgaatagtcaggttgacaaggtaaatgacccaacagagagtcaacaagaagatcaactaatagcaggggcacaagatgaagcgaaggaacaaagaaatggaactaaatgacaatcctcagcatcgcaaggcctctcctggctctgggggagctcgggaagatagcagcacacgctgtggaggagggtgggggtggggggaaggcaagtcccatggaaggacggggaatcctttactctaatttctccagctgcattttgttccgtttatctgcagaaaaagaaagaaaaaaaagaaaaaaaaagtttcctttaatttggtggagggacccatgttgacgcatctttcaggcattatccttgtaatttctgtcttttctcttacaactttgccccagggtcacagtggcttgattgaacactcacatgtgtatcctggcccctgtctgctttcttggttatttcacaaagctggtcacacagtggtttattcaaaggaaggggaggaagacagtggtttgataagctgcaggataaattttaggaatcaatgagcccagcagcagtataatccccagacagaggaggcaggatagaaaatgggcaaaagcctcggaaaccacttggaaaaggtctggacaatgaggtgaaaatattttcttcagggttcccaaggcacaatttgttccaagtggctaatgagaaatatggaagctgaattttttccagagcagagtgcagaggcataacagaagggtgggccctggcagccatctgggtctcttccttcctaaccatggtggcaggtgcatccttctttgacactgactttcagcagagcttacttggttcatgaggtcttcacatggagactaccagcaagaggtgactctctgctgcataactgtaaaggatggccctttgctaggtgttacagttaaaagctaagaaaaggggcagtgcatttaggacccaaacatatgcctatgaatatcaaaagctcctcctgaaattgctgtgagttttccataaaagaatatcctgtcttcacccaaggcttgacagcccacagagtggtctcatttgaaattacaggaaattagagcttttgcttgcagttctgccttcctggcctgtgtttaaatgctgtcacttgtttatgccaagttcaaggctgattcaatggttggtcccctcacccagaaaaccctgaaggggaggatacagctctgaaggggggcagcagtactaaaaacccaagatgccagtggtatagtgggcacaagggatggcgaccatgaggatgccaggcatcatcaccaatatctatcctagagccagtataaggccagatgcctacttcccacagcctccccgggttccaaagtcatgtcattgttttcagtggaaacatatcgtttgttgcatatcttcttaaatccatcttccttgtaagggctttagaactaaaacttacttatattgtttttccttaacagagggagaaaaatagtggattattatttctaaaataaaaggatgttctgctttctaaatatcccatcaaaatcttcagttttgcacttttttgatggaaaattcatcttatcttcctatgactttggttttagcctttctgaatttgttaccccttctggatggcttatttgatatactggaatagttaacaagctatacttcagcatatgcactatattctaacaaattttttttaataaaatcaagacatcagcaagaatgacatttacgtgacctcataatgtgggattatggccttctgttgctattccagtttgatatggaagcatctatatcctctattgccgttagatgttgttgcttttcagaaaagtaacgaaaaggctcattttaaagaatccaagaaacgatgtcatccaaatattgacagtttctacatttcatgccatctttataactcaattgaaagttgccgtcattcttgtgaagtatttgacaagtgcaatctgctagaagctcgtttttcttgtgactcccaaatgttagtgctacttagcctcagtaatgagttacagttgaaaaaaacatgagggaaacagagggacagagattttctaatgaacaatgatggaagagacctaatgtccttgctagaaacagccaggatggaaattatccagccctggcattctccttatcatcaatgacagtcattttattcatttatttcaaatgtgggtgggctagaagtggaaggagggaattctctctgcctaaaaattctagaagaatgaaagtaatctttgtatccaggaaactaagagaatgaggaataaatatcttcagcccgactcctgaatttgtttattcttccatctataattagattgtgttttcatttttgctttgtcatgctttttggttgttatttggctatacagttttatgctttaaaacaaatgataaagttaatttccaattcaatagtgaaatattaacaatctaactatagccagatcaaagacacctgaacacagaaaacctttatttgctggtgctgccattgcacaggctgtacaatgaaatagatttgaaaagctgattgattttcccgcacataaattctggatgtcaatttccaaccaaactccaatacagctatgtggcatgaagagttacaggagggagggaggaaaatagccctatgttagtcatgtttgcatacagaggatcaaagtaggccttcaccataatagttctaattaaaatggtcctcgctgtaggagagacaaaggggcttttcctctagctggtaactattcagatgatggacaagtcttctttcataaaagattacaaagaaggcatccgaatcactgtctgtgatactgggtcacatattaatcactgcagctaattgtaaatctttctatgaaacactgaaaagcctctttgtgaattaatacagttctgcttgatgcacttgatttgaaaagacatttctctgtatgtggcgcatgtcggctttgctttgaaaaataacaaagttagcagaatatgttcaatatattttcttggggaatagggtttttattacatgattcattaaggatttgccttaccctgacatttgtgatataaaggaaaatcagaaaaaaagtaattttcttgatcaagatatgtttttacttaatgcaaataaatgtagtctgttgcttgcaaggaaaaaaaaatggcttctgatatctggtataaactgctaaataggataatacgtgcctcttttgttaaaccggcatttaaatgctggactgcttctaaatctgtttgtttcttttcatctgtgccatacactaaaaaacaactgttgccttcatactatatttgttagagcagaatacaaataaaatttgtttgagaggataatgtgaaa

SEQ ID NO: 150440 - DNA, 4425 bp, Homo sapiens
  Payload ID: 9716
  Gene Symbol: MACROD2
  Gene Name: MACRO domain containing 2
  Uniprot ID: A1Z1Q3
  ENST ID: ENST00000402914
  CDS Start-End: 463-1104
actatcgagaagcagatgacaggctcaggccttaccagggatgcacttgccacattttggaaagactacataaaaaacctttaaaaattggagccctttgggcctcaggtatccaaagagcacattttttggaaactcaacactcaggaaggtcgcatagagccagtttatgcagatgtcatccatactgtagggccaatagccaggggccatattaatggttcccacaaggaagaccttgcaaattgctataaatcatctctgaagctcgtgaaagaaaataacatccgatcagttgcatttccctgcatctcaacaggcatttatggctttcccaacgagcctgctgcagtcattgccctcaacaccattaaggaatggcttgccaagaatcaccatgaggtggatcggatcattttctgtgtcttcttagaagttgacttcaaaatctacaaaaagaaaatgaatgagtttttctccgtagacgataataatgaagaagaagaggatgttgaaatgaaagaagattcagatgagaacggtccagaggagaagcaaagtgtggaagaaatggaagagcagagccaagatgcagatggtgtcaacactgtcactgtgcccggccctgcttcagaagaggcagttgaagactgtaaagatgaagattttgcaaaggatgaaaatattacaaaaggcggtgaagtgacagatcattctgtgcgtgaccaagatcatcccgatggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgttgaaatgaatagtcaggttgacaaggtaaatgacccaacagagagtcaacaagaagatcaactaatagcaggggcacaagatgaagcgaaggaacaaagaaatggaactaaatgacaatcctcagcatcgcaaggcctctcctggctctgggggagctcgggaagatagcagcacacgctgtggaggagggtgggggtggggggaaggcaagtcccatggaaggacggggaatcctttactctaatttctccagctgcattttgttccgtttatctgcagaaaaagaaagaaaaaaaagaaaaaaaaagtttcctttaatttggtggagggacccatgttgacgcatctttcaggcattatccttgtaatttctgtcttttctcttacaactttgccccagggtcacagtggcttgattgaacactcacatgtgtatcctggcccctgtctgctttcttggttatttcacaaagctggtcacacagtggtttattcaaaggaaggggaggaagacagtggtttgataagctgcaggataaattttaggaatcaatgagcccagcagcagtataatccccagacagaggaggcaggatagaaaatgggcaaaagcctcggaaaccacttggaaaaggtctggacaatgaggtgaaaatattttcttcagggttcccaaggcacaatttgttccaagtggctaatgagaaatatggaagctgaattttttccagagcagagtgcagaggcataacagaagggtgggccctggcagccatctgggtctcttccttcctaaccatggtggcaggtgcatccttctttgacactgactttcagcagagcttacttggttcatgaggtcttcacatggagactaccagcaagaggtgactctctgctgcataactgtaaaggatggccctttgctaggtgttacagttaaaagctaagaaaaggggcagtgcatttaggacccaaacatatgcctatgaatatcaaaagctcctcctgaaattgctgtgagttttccataaaagaatatcctgtcttcacccaaggcttgacagcccacagagtggtctcatttgaaattacaggaaattagagcttttgcttgcagttctgccttcctggcctgtgtttaaatgctgtcacttgtttatgccaagttcaaggctgattcaatggttggtcccctcacccagaaaaccctgaaggggaggatacagctctgaaggggggcagcagtactaaaaacccaagatgccagtggtatagtgggcacaagggatggcgaccatgaggatgccaggcatcatcaccaatatctatcctagagccagtataaggccagatgcctacttcccacagcctccccgggttccaaagtcatgtcattgttttcagtggaaacatatcgtttgttgcatatcttcttaaatccatcttccttgtaagggctttagaactaaaacttacttatattgtttttccttaacagagggagaaaaatagtggattattatttctaaaataaaaggatgttctgctttctaaatatcccatcaaaatcttcagttttgcacttttttgatggaaaattcatcttatcttcctatgactttggttttagcctttctgaatttgttaccccttctggatggcttatttgatatactggaatagttaacaagctatacttcagcatatgcactatattctaacaaattttttttaataaaatcaagacatcagcaagaatgacatttacgtgacctcataatgtgggattatggccttctgttgctattccagtttgatatggaagcatctatatcctctattgccgttagatgttgttgcttttcagaaaagtaacgaaaaggctcattttaaagaatccaagaaacgatgtcatccaaatattgacagtttctacatttcatgccatctttataactcaattgaaagttgccgtcattcttgtgaagtatttgacaagtgcaatctgctagaagctcgtttttcttgtgactcccaaatgttagtgctacttagcctcagtaatgagttacagttgaaaaaaacatgagggaaacagagggacagagattttctaatgaacaatgatggaagagacctaatgtccttgctagaaacagccaggatggaaattatccagccctggcattctccttatcatcaatgacagtcattttattcatttatttcaaatgtgggtgggctagaagtggaaggagggaattctctctgcctaaaaattctagaagaatgaaagtaatctttgtatccaggaaactaagagaatgaggaataaatatcttcagcccgactcctgaatttgtttattcttccatctataattagattgtgttttcatttttgctttgtcatgctttttggttgttatttggctatacagttttatgctttaaaacaaatgataaagttaatttccaattcaatagtgaaatattaacaatctaactatagccagatcaaagacacctgaacacagaaaacctttatttgctggtgctgccattgcacaggctgtacaatgaaatagatttgaaaagctgattgattttcccgcacataaattctggatgtcaatttccaaccaaactccaatacagctatgtggcatgaagagttacaggagggagggaggaaaatagccctatgttagtcatgtttgcatacagaggatcaaagtaggccttcaccataatagttctaattaaaatggtcctcgctgtaggagagacaaaggggcttttcctctagctggtaactattcagatgatggacaagtcttctttcataaaagattacaaagaaggcatccgaatcactgtctgtgatactgggtcacatattaatcactgcagctaattgtaaatctttctatgaaacactgaaaagcctctttgtgaattaatacagttctgcttgatgcacttgatttgaaaagacatttctctgtatgtggcgcatgtcggctttgctttgaaaaataacaaagttagcagaatatgttcaatatattttcttggggaatagggtttttattacatgattcattaaggatttgccttaccctgacatttgtgatataaaggaaaatcagaaaaaaagtaattttcttgatcaagatatgtttttacttaatgcaaataaatgtagtctgttgcttgcaaggaaaaaaaaatggcttctgatatctggtataaactgctaaataggataatacgtgcctcttttgttaaaccggcatttaaatgctggactgcttctaaatctgtttgtttcttttcatctgtgccatacactaaaaaacaactgttgccttcatactatatttgttagagcagaatacaaataaaatttgtttgagaggataatgtgaaa

SEQ ID NO: 150441 - DNA, 727 bp, Homo sapiens
  Payload ID: 9716
  Gene Symbol: MACROD2
  Gene Name: MACRO domain containing 2
  Uniprot ID: A1Z1Q3
  ENST ID: ENST00000407045
  CDS Start-End: 238-534
caaaacttctcagacaccgagttgtagaaggaagggctttattcagctgggagcatcggcaagctactgccttaaaatccgagctccccaaatgcacaatttctgtcccttttaagggctcacagcactaaagatttcacatgaaagggtcgtgattgatttgagcaagcagggggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgttgaaatgaatagtcaggttgacaaggtaaatgacccaacagagagtcaacaagaagatcaactaataggggcacaagatgaagcgaaggaacaaagaaatggaactaaatgacaatcctcagcatcgcaaggcctctcctggctctgggggagctcgggaagatagcagcacacgctgtggaggagggtgggggtggggggaaggcaagtcccatggaaggacggggaatcctttactctaatttctccagctgcattttgttccgtttatctgcagaaaaagaaagaaaaaaaagaaaaaaaaa

SEQ ID NO: 150442 - DNA, 2058 bp, Homo sapiens
  Payload ID: 9717
  Gene Symbol: MAEA
  Gene Name: macrophage erythroblast attacher
  Uniprot ID: Q7L5Y9
  ENST ID: ENST00000264750
  CDS Start-End: 24-1091
gctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctc

SEQ ID NO: 150443 - DNA, 2222 bp, Homo sapiens
  Payload ID: 9717
  Gene Symbol: MAEA
  Gene Name: macrophage erythroblast attacher
  Uniprot ID: Q7L5Y9
  ENST ID: ENST00000303400
  CDS Start-End: 64-1254
tcatttcccggcgtgcagcgcgctcgcgcgtcccccgcccgctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctca

SEQ ID NO: 150444 - DNA, 845 bp, Homo sapiens
  Payload ID: 9717
  Gene Symbol: MAEA
  Gene Name: macrophage erythroblast attacher
  ENST ID: ENST00000503653
  CDS Start-End: 24-845
gctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacacc

SEQ ID NO: 150445 - DNA, 1340 bp, Homo sapiens
  Payload ID: 9717
  Gene Symbol: MAEA
  Gene Name: macrophage erythroblast attacher
  ENST ID: ENST00000505177
  CDS Start-End: 28-1332
gcccgctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagggccgccaaaacaagcacgaagcaaagacgggacgaaaaagtagagcggctagtagctcccctaaagagagtttggaccttggtatggaaaccctaaaaggaaagccagaattgagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacg

SEQ ID NO: 150446 - DNA, 839 bp, Homo sapiens
  Payload ID: 9717
  Gene Symbol: MAEA
  Gene Name: macrophage erythroblast attacher
  ENST ID: ENST00000512308
  CDS Start-End: 24-227
gctaatgttttggccgcttcaagatggcggtgcaggagtcggcggctcagttgtccatgaccctgaaggtccaggagtacccgaccctcaagaacattccagcatggaaaccccgctgtgcaaggcccctgcactggccacagaagccgcacctatctgctgaggaacccggttgctgcctggagtgggtgtcgagtactgcctggcagcatagccatgcttcttgaggcattttagcaccctgtaccccaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgag

SEQ ID NO: 150447 - DNA, 595 bp, Homo sapiens
  Payload ID: 9717
  Gene Symbol: MAEA
  Gene Name: macrophage erythroblast attacher
  ENST ID: ENST00000513301
  CDS Start-End: 25-348
cgctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggttggtcccgcctggcggtccctcttcagtctggggcatggacaccccttttgtctcgaaaatgagtcctaagacaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaaga

SEQ ID NO: 150448 - DNA, 1444 bp, Homo sapiens
  Payload ID: 9717
  Gene Symbol: MAEA
  Gene Name: macrophage erythroblast attacher
  ENST ID: ENST00000505839
  CDS Start-End: 286-1332
ttgcactgggagcaaagggttcctgtctgcagcacaccagctgcccggagctctgccctgtgcctgagcagcgtcagcaccgcggtgaggcggacggcccggcaggggttggaaagtccagaaaggccccgttcccgcgtagaacttgaatgcagctaagggacgtccagagaggcctttccttttctggtggcggtctggaatgtgctggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgacc

SEQ ID NO: 150449 - DNA, 598 bp, Homo sapiens
  Payload ID: 9717
  Gene Symbol: MAEA
  Gene Name: macrophage erythroblast attacher
  ENST ID: ENST00000509254
  CDS Start-End: 21-344
aatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggttggtcccgcctggcggtccctcttcagtctggggcatggacaccccttttgtctcgaaaatgagtcctaagacaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagtgggccgggtggccgagtgttccacagaaggcccatttggagaagtggg

SEQ ID NO: 150450 - DNA, 1607 bp, Homo sapiens
  Payload ID: 9717
  Gene Symbol: MAEA
  Gene Name: macrophage erythroblast attacher
  ENST ID: ENST00000510794
  CDS Start-End: 205-1392
ggcctggctcctctggggggcgtggatgtggggaggagctgctgtctgggtcagcagctgccctgctggagggagagggggtgctgcgctcatcccctgaactcagattggatagccccgggccagcgctggaggaggagcagaggcagggaggtgggaggagcgtgcgcagaggcgtgggaggcctgaggagtaagcggctggatgtggaccctgagagccactggcagggaggtggggtcttccagttgtgaagacaccgtggccccggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtc

SEQ ID NO: 150451 - DNA, 570 bp, Homo sapiens
  Payload ID: 9717
  Gene Symbol: MAEA
  Gene Name: macrophage erythroblast attacher
  ENST ID: ENST00000502558
  CDS Start-End: 21-570
aatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatct

SEQ ID NO: 150452 - DNA, 1001 bp, Homo sapiens
  Payload ID: 9717
  Gene Symbol: MAEA
  Gene Name: macrophage erythroblast attacher
  ENST ID: ENST00000509531
  CDS Start-End: 1-738
atggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtc

SEQ ID NO: 150453 - DNA, 550 bp, Homo sapiens
  Payload ID: 9717
  Gene Symbol: MAEA
  Gene Name: macrophage erythroblast attacher
  ENST ID: ENST00000512842
  CDS Start-End: 205-550
gatgtggggaggagctgctgtctgggtcagcagctgccctgctggagggagagggggtgctgcgctcatcccctgaactcagattggatagccccgggccagcgctggaggaggagcagaggcagggaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggcca

SEQ ID NO: 150454 - DNA, 1945 bp, Homo sapiens
  Payload ID: 9717
  Gene Symbol: MAEA
  Gene Name: macrophage erythroblast attacher
  ENST ID: ENST00000514708
  CDS Start-End: 20-1006
atgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacacctgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaacc

SEQ ID NO: 150455 - DNA, 4442 bp, Homo sapiens
  Payload ID: 9718
  Gene Symbol: MPEG1
  Gene Name: macrophage expressed 1
  Uniprot ID: Q2M385
  ENST ID: ENST00000361050
  CDS Start-End: 87-2237
atctgcttctgttttctccatcttagtttgcccaaagcttgctggccgctgtgtagggctggtgagtggctggggctgtctgagccatgaacaacttcagggccaccatcctcttctgggcagcggcagcatgggctaaatcaggcaagccttcgggagagatggacgaagttggagttcaaaaatgcaagaatgccttgaaactacctgtcctggaagtcctacctggagggggctgggacaatctgcggaatgtggacatgggacgagttatggaattgacttactccaactgcaggacaacagaggatggacagtatatcatccctgatgaaatcttcaccattccccagaaacagagcaacctggagatgaactcagaaatcctggaatcctgggcaaattaccagagtagcacctcctactccatcaacacagaactctctcttttttccaaagtcaatggcaagttttccactgagttccagaggatgaagaccctccaagtgaaggaccaagctataactacccgagttcaggtaagaaacctcgtctacacagtcaaaatcaacccaactttagagctaagctcaggttttaggaaggaactccttgacatctctgaccgtctagagaacaaccagacgaggatggccacctacctggcagaactcctggtgctcaactatggcacccacgtcaccaccagtgtcgacgctggggctgctcttattcaggaggaccacctcagggcctccttcctccaagacagccagagcagtcgtagtgccgtgaccgcctctgctggacttgcctttcaaaacaccgtgaacttcaaatttgaggaaaactatacctcgcagaatgtcctcaccaagagctacctctcaaaccgaaccaactccagggtgcagagcattggaggggttcctttttacccaggcatcaccctccaggcctggcagcagggtatcaccaaccacctggtggccatcgaccgctctggcctgccgctgcatttcttcatcaaccccaacatgctacctgacttgccaggccccctggtgaagaaggtgtcaaagacagtggaaactgctgtgaagcgctattatacattcaacacctaccctggctgcacagatctcaattctcccaacttcaattttcaggccaacacggatgatggctcctgcgaggggaaaatgaccaacttctctttcggtggggtttatcaggaatgcactcagctctcagggaatagggatgtcctcctctgccaaaagttggagcagaagaatccactcactggtgatttctcctgcccctctggctactccccggtgcacctgttatcccagatccacgaggagggttacaaccacctggagtgtcatcgaaagtgcactctcctcgtcttctgcaagaccgtgtgtgaagatgtgttccaggtggcaaaagctgaatttagggctttttggtgtgtggccagcagccaagtacctgaaaactcaggactgctttttgggggcctcttcagcagcaagagcataaaccccatgacaaatgcacagtcatgcccagccggctactttccactgagactctttgaaaacctcaaggtatgtgtttctcaggactatgagttgggaagcaggtttgcggtcccctttggcgggttctttagctgcacagttgggaaccccctggtagatcctgctatatccagagatttaggggcaccgtctctgaaaaagtgccccgggggcttcagccagcacccagccctcatcagcgatggatgccaagtgtcctattgcgtcaaatccgggctcttcacaggagggtccctgccccctgccaggctcccacctttcacccggccacccctcatgagtcaggctgccaccaatactgtcatagtgaccaattctgagaatgcgagatcctggattaaagactcccagacccaccagtggaggctgggagaaccgatagagctgcggagggccatgaatgtcatccatggggatggtggtggtctgtcaggaggggctgcagctggggtcacagtgggggtcaccaccattctggctgttgttatcaccttggccatctacggcacccggaagttcaagaagaaagcatatcaggcaattgaggaaaggcagagtttggttccaggcactgcagcaactggagacaccacttaccaagagcaggggcagagtccagcttaaatctctccccgaaaatggtttctctcatctccagtgtggtcattgctgaccactctgttttcctaagcattgaaatggcaagtgcaaccaaaagtaggtatattcgtgacttcttgtttaggtctctgggccaggaaattcatactgttacatggataaggttgggattggggagagggaacagttgggactagaagcaaaagtgattctgggactaaaataggaagcagatgtcctttcccaatgtgtgttgctgtcttcacctgaatgcatttgtgtaaaaatagcggagggacaatgtgaacatttgtatttggaagctatgaatttactctgaagtttgcagttgtttccaatttgtgagctctaagagtttctgcctgtaagaactactctccttttattttgatttttaaaaacctgtctgaatttcacactcttagagcctggaagagccctgaaaagacacaagtcttgcctggctactgctttttaactttgagggctctatgttgacagactgttatctcctctgggtgacctcaaacatctgaaaagaaagatgttgcctgtgccaattccactttttccagctgccccttgatgaacactcccttataccagaccactcttggacttctgactggtgtcatcaagtcctcagaaaatattttaagttattttaagttattaaggaagggatgatttggagacaaggagtaatgaaagatgggtaaaaactggaaaagattctggtgctaagtactaccccttcatcttccatggatggtcattacctttcctgtcctcctgttatatgaacacacacacacacacacacacacacacacacacacacgcacacacataccacatttcaataagtcttcattgttctgggtccttacctttcctgtcctcctgttatatgaacacacacacacacacacacacacacacacacgcacaccacatttcaatgtctgcatggttctgggggtaacaaaggcaagaagttaaagtaagaccacatttgagtattacttactctgtagaatcaaaacagagtagttaacaccaattatgcaaactacttttttttccagcagaaagggagctgacatgatcaaatccatgttttcaaatgaactgaaaaaggcatccagcaccacttataacacatttatttcagttccaggctgacagccctggggcatctagcaggatgcataattgtcatctggtgagagttgggactttgctcaattttaataccaatctctcctgattgtaattacctccactactttcatgatccccctacaatatttttttaaatgatatatttattcactgaatcaaatgtcattaatgagttatcttctgtggaggatgactgttctctttgttaatgttcacaatcaagatcttgggctgagaagaggcccttcacccaaggagtttgaagtatcacagtgtgtgggaaggtgggaaccaggatacccattcatttccaaccgagacacagagaagtgagtcacagaatttgagcccgctctcttgactgcccagccagagacactgatttctgtaacctcttcacttgatcctgcctcttaagcattaaaacattctcctaaacctctgagtgttttgtgggttctgggtgttttgtacattttagccaagctaaccacttgtctgcaagtactgactttcctatgaattctttgaagattattgagtcagaaaggaaaaatatagccccaaattcccaggcttttaatgcattacattaactgcctattgaaatgagaagttcttcacaaacttgtatacccactaacaagattgcacataaacatgcattaaagtatatactaagaaaccctctgtccaacggctcatgcatatgaagtccgaacatgggagtttgccaattgcattcatcaagtcgttttgcggagtcagatccctgatggaagagctcacaggctctgccttccaagtcctgggttcctaactggtgaccttagcctggggtctgtggggagaccaaccctggcttccaagaaaaccacattccatggactatcagaaatagacacagatttgggtgacaaagctggctctgtatttgcattttatttttgtgttcttgtcagtttgggaatgattaatattaaacatttatttgagaaacaa

SEQ ID NO: 150456 - DNA, 939 bp, Homo sapiens
  Payload ID: 9719
  Gene Symbol: MIF
  Gene Name: macrophage migration inhibitory factor (glycosylation-inhibiting factor)
  Uniprot ID: P14174
  ENST ID: ENST00000215754
  CDS Start-End: 472-819
acaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactagga

SEQ ID NO: 150457 - DNA, 939 bp, Homo sapiens; identical to SEQ ID NO: 150456
  Payload ID: 9719
  Gene Symbol: MIF
  Gene Name: macrophage migration inhibitory factor (glycosylation-inhibiting factor)
  Uniprot ID: P14174
  ENST ID: ENST00000613839
  CDS Start-End: 472-819

SEQ ID NO: 150458 - DNA, 1838 bp, Homo sapiens
  Payload ID: 9720
  Gene Symbol: MARCO
  Gene Name: macrophage receptor with collagenous structure
  Uniprot ID: Q9UEW3
  ENST ID: ENST00000327097
  CDS Start-End: 136-1698
agagccaaagggaagtgctgcgaggtttacaaccagctgcagtggttcgatgggaaggatctttctccaagtggttcctcttgaggggagcatttctgctggctccaggactttggccatctataaagcttggcaatgagaaataagaaaattctcaaggaggacgagctcttgagtgagacccaacaagctgcttttcaccaaattgcaatggagcctttcgaaatcaatgttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccagggatgttcagaatcaaaggtgaacaaggcgccccaggtcttcaaggtcacaagggggccatgggcatgcctggtgcccctggcccgccgggaccacctgctgagaagggagccaagggggctatgggacgagatggagcaacaggcccctcgggaccccaaggcccaccgggagtcaagggagaggcgggcctccaaggaccccagggtgctccagggaagcaaggagccactggcaccccaggaccccaaggagagaagggcagcaaaggcgatgggggtctcattggcccaaaaggggaaactggaactaagggagagaaaggagacctgggtctcccaggaagcaaaggggacaggggcatgaaaggagatgcaggggtcatggggcctcctggagcccaggggagtaaaggtgacttcgggaggccaggcccaccaggtttggctggttttcctggagctaaaggagatcaaggacaacctggactgcagggtgttccgggccctcctggtgcagtgggacacccaggtgccaagggtgagcctggcagtgctggctcccctgggcgagcaggacttccagggagccccgggagtccaggagccacaggcctgaaaggaagcaaaggggacacaggacttcaaggacagcaaggaagaaaaggagaatcaggagttccaggccctgcaggtgtgaagggagaacaggggagcccagggctggcaggtcccaagggagcccctggacaagctggccagaagggagaccagggagtgaaaggatcttctggggagcaaggagtaaagggagaaaaaggtgaaagaggtgaaaactcagtgtccgtcaggattgtcggcagtagtaaccgaggccgggctgaagtttactacagtggtacctgggggacaatttgcgatgacgagtggcaaaattctgatgccattgtcttctgccgcatgctgggttactccaaaggaagggccctgtacaaagtgggagctggcactgggcagatctggctggataatgttcagtgtcggggcacggagagtaccctgtggagctgcaccaagaatagctggggccatcatgactgcagccacgaggaggacgcaggcgtggagtgcagcgtctgacccggaaaccctttcacttctctgctcccgaggtgtcctcgggctcatatgtgggaaggcagaggatctctgaggagttccctggggacaactgagcagcctctggagaggggccattaataaagctcaacatcattggc

SEQ ID NO: 150459 - DNA, 569 bp, Homo sapiens
  Payload ID: 9720
  Gene Symbol: MARCO
  Gene Name: macrophage receptor with collagenous structure
  ENST ID: ENST00000412481
  CDS Start-End: 379-569
aaagcttggcaatgagaaataagaaaattctcaaggaggacgagctcttgagtgagacccaacaagctgcttttcaccaaattgcaatggagcctttcgaaatcaatggatgaggagtgtaaatttcacactgtaccctctagaagcacagtgcaacttgcatccctctttcctgccatcacctccagcctccctcattagaacaagcctccttcattccattatctgcactagaattaagttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccagg

SEQ ID NO: 150460 - DNA, 3572 bp, Homo sapiens
  Payload ID: 9721
  Gene Symbol: MSR1
  Gene Name: macrophage scavenger receptor 1
  Uniprot ID: P21757
  ENST ID: ENST00000350896
  CDS Start-End: 199-1365
aaatttagattttgcaaacctgtgcattgatgagagtgctattgaaacacattaagaaagattttcaacgcaggaatgtgtcatttcctttcttcatgtaccagatgctgaaatactatgagataaagattttaggtttcaattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaagtactggtccaatatggctgaatgaagtgttttgttttgggagagaatcatctattgaagaatgtaaaattcggcaatgggggacaagagcctgttcacattctgaagatgctggagtcacttgcactttataatgcatcatattttcattcacaactatgaaatcgctgctcaaaaatgattttattaccttgttcctgtaaaatccatttaatcaatatttaagagattaagaatattgcccaaataatattttagattacaggattaatatattgaacaccttcatgcttactattttatgtctatatttaaatcattttaacttctataggtttttaaatggaattttctaatataatgacttatatgctgaattgaacattttgaagtttatagcttccagattacaaaggccaagggtaatagaaatgcataccagtaattggctccaattcataatatgttcaccaggagattacaattttttgctcttcttgtctttgtaatctatttagttgattttaattactttctgaataacggaagggatcagaagatatcttttgtgcctagattgcaaaatctccaatccacacatattgttttaaaataagaatgttatccaactattaagatatctcaatgtgcaataacttgtgtattagatatcaatgttaatgatatgtcttggccactatggaccagggagcttatttttcttgtcatgtactgacaactgtttaattgaatcatgaagtaaattgaaagcaggacatatgagaaaactgaccatcagtatatttgtccagataattggtggatcaaaaatgccacttaacaggaagtttagtttgttatgcactttaaatggaataattagcttgttacaattctaggacatggtgtttaaaatttaaatctgattaatccattttaacaaacaatgcaaacatcttcagtgcagaaggaagagtggtttcaactgtttggagtcttttatgaagtcagtcaacatttacaaccaaagggcgggggggggggtggggggtgcgtctttagtcctaaagggacaataactctgagcatgccccaaaaaagtagtttagcaaccttttgttggtagtcaacccatccccagggccatagtgtagagtgtgaaaagctaccctgaaacccagtaattctaccctgaaagtgactgcctgcagaaagaccagcagttgatattaaagcgcaaatgaattcaacctcagccctgaaaataacagaattctgaagtttcctatgactaattcacaaaaaaagtaattgtaaactagtactattatggaattactctactgttctttctttaatagtggcaaatgaaagcataagcttaagcattttttcatattctgaagtctcaccacacataataaccaagtggtagactcacagccgtccaacttaaaaaggcaaaaccttaccttggaattggaattactgtaaacagcctactgaaaatgcatttttatcatgtaacattcttctacttgtttaacattgctgattttctctggcagcataattttgtggttaagagaatgaattctgaatgtacactttctgtctcaaaccctggctgtaatttcagctagttaataattctttgtgttcagttccactatctaggtattttcttcaaaaggtaaatacaatggtttctgaaagaatcatttgcattatcagcctgtttgggatgtctgagatcagtgcctctgggttgttaatactgtattgctgtatggtatatgtatgctgatttactacttatgcgtaagtggtatgcatgggatgtctgaaatcagtgcctatgggttgtcaatagtattaactattagtgttaactgttagtattaactattagtattattaacactaataatagtactattactattactatttttattttaaaataaaatttacctttaaaataataatagtactattgctagtactagtactattgctattactagtactattactagtactagtactatgacactgttaatagtactattaacaacccataggcacttgggatgtctgagatcagtgcctatgggttgttaatactatattgctgtatggtatatgcatgctgatttaccacttatgcatagatatatctttaataagtaatctaaaaatcctttttgtatttgagagaatctactaagttcagtccagtcaagaaaagaacctaatagcaccaatacaaattgaggacttaatttactttggaatgttgaattgcatttgttccattaaaaaaaacagaaatttgcga

SEQ ID NO: 150461 - DNA, 2132 bp, Homo sapiens
  Payload ID: 9721
  Gene Symbol: MSR1
  Gene Name: macrophage scavenger receptor 1
  Uniprot ID: P21757
  ENST ID: ENST00000262101
  CDS Start-End: 123-1478
tgtgtcatttcctttcttcatgtaccagatgctgaaatactatgagataaagattttaggtttcaattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaactccatttacgaaagttcgactggtcggtgggagcggccctcacgaggggagggtggagatactccacagcggccagtggggtacaatttgtgacgatcgctgggaagtgcgcgttggacaggtcgtctgtaggagcttgggatacccaggtgttcaagccgtgcacaaggcagctcactttggacaaggtactggtccaatatggctgaatgaagtgttttgttttgggagagaatcatctattgaagaatgtaaaattcggcaatgggggacaagagcctgttcacattctgaagatgctggagtcacttgcactttataatgcatcatattttcattcacaactatgaaatcgctgctcaaaaatgattttattaccttgttcctgtaaaatccatttaatcaatatttaagagattaagaatattgcccaaataatattttagattacaggattaatatattgaacaccttcatgcttactattttatgtctatatttaaatcattttaacttctataggtttttaaatggaattttctaatataatgacttatatgctgaattgaacattttgaagtttatagcttccagattacaaaggccaagggtaatagaaatgcataccagtaattggctccaattcataatatgttcaccaggagattacaattttttgctcttcttgtctttgtaatctatttagttgattttaattactttctgaataacggaagggatcagaagatatcttttgtgcctagattgcaaaatctccaatccacacatattgttttaaaataagaatgttatccaactattaagatatctcaatgtgcaataacttgtgtattagatatcaatgttaatgatatgtcttggccactatggaccagggagcttatttttcttgtcatgtactgacaactgtttaattgaatcatgaagtaaattgaaagcaggacatatgagaaaa

SEQ ID NO: 150462 - DNA, 1167 bp, Homo sapiens
  Payload ID: 9721
  Gene Symbol: MSR1
  Gene Name: macrophage scavenger receptor 1
  Uniprot ID: P21757
  ENST ID: ENST00000355282
  CDS Start-End: 1-1167
atggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaagtactggtccaatatggctgaatgaagtgttttgttttgggagagaatcatctattgaagaatgtaaaattcggcaatgggggacaagagcctgttcacattctgaagatgctggagtcacttgcactttataa

SEQ ID NO: 150463 - DNA, 2826 bp, Homo sapiens
  Payload ID: 9721
  Gene Symbol: MSR1
  Gene Name: macrophage scavenger receptor 1
  Uniprot ID: P21757
  ENST ID: ENST00000381998
  CDS Start-End: 67-1143
taggtttcaattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaagaccagtacaactcactgatcatattagggcagggccctcttaagatcaggtgggttgggcgggacatcctctgctaccatctcattaaaaggcccttcacctctggacaagtcatctgcacaactgacttccaagatccttttgtgactcctccaaatgactttggttcccgtgttgtacctgacttccacatggccttctctcctggtccctggtgctgtttgggcctctgctcccatgctcatacctcttcttactccaattactccaccatcacctctctcccctatcacccccagcctggacacctctcatgcacggactggagggctgctccaaccagtcctcagttctctgccacccattgacctagagtcttgaacccaatttaatttattgggttctaggagaactgctgtgttctcaccctaacttggaagagtgatgtttcagtcaagcaaagcgattcctaccatacaatataacacttgtgtgaggctctgtcctaaatatctcaattaccaatatgtggtttggtagtatttctcgccatgctttgctcatgcgcaatgagactacaactagggtgtaaattttaagtatcccatctaaaactcatacaatgataggaaaaatccatttgtttttcatttgatttttactgaggaatcagctcaatcttcaatgaatactggtctctttccaaagcatttttgatcaaagtaaagactgagtcaagggctttttttttttctttttcttgttttaagagacagagccttgttctattgcacaggctggactacacgcattcacctagagtctagaacacaatttaatttattgggttctaggagaactgtcatgagtattgataatatgagagttctttatattcaaacattattctcaaccagagatagggatgtcatagaagaaaatccattcattcaatcattaattcacatgtccattatgtacctccatgagctggacataacagctaataagagataattgtctctggttttacagagctaattgtccctaagagatgtagacaaatgaacaagcaattacaatacatctaagctatactgggggaggaacagggctggataggtatgcagaggagataaaaaaattttaattccttagaatattttttaaaaattgattcttattttaccttctcatcttcttattttccaaattacagcatatatatatatatatatatatatatatatatatatatatatatatatattttttttttttttttttttttttttttaagttttgaagtgtagtcgagcttgggcaatttatccaacccatttaaaccaaaaataaaacttttcatgtattacctggtcatttcaaacaaaaatattttgatcatgaaaaagaataccaatattcttttgttctaaaaatctcttatgggattacatgttatatttttggtttctctctactgatcaacagactacattttcacaactcttctttcctttacgttttaacacacagacccaagattcatactattaagattctagtagaactctagatggtatgcctctgtgtatctcagcatttttattcccactcttgtataatgaacatgttaacacctacctcacagggttgttgtgaggatcaagtaagatattgtgtgtgtgaagatgctctgtgaaatcataaagtcctttaaagatgt

SEQ ID NO: 150464 - DNA, 1513 bp, Homo sapiens
  Payload ID: 9721
  Gene Symbol: MSR1
  Gene Name: macrophage scavenger receptor 1
  ENST ID: ENST00000445506
  CDS Start-End: 65-1474
actctgctgttgagacgttggggagatgaggaggaatacccagaaataaataaaactcccctggatgtgctatctcagtgcaatcatcagtatctctcttctcaacaaaaaaccaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaactccatttacgaaagttcgactggtcggtgggagcggccctcacgaggggagggtggagatactccacagcggccagtggggtacaatttgtgacgatcgctgggaagtgcgcgttggacaggtcgtctgtaggagcttgggatacccaggtgttcaagccgtgcacaaggcagctcactttggacaaggtactggtccaatatggctgaatgaagtgttttgttttgggagagaatcatctattgaagaatgtaaaattcggcaatgggggacaagagcctgttcacattctgaagatgctggagtcacttgcactttataatgcatcatattttcattcacaactatgaaatcgctgctc

SEQ ID NO: 150465 - DNA, 353 bp, Homo sapiens
  Payload ID: 9721
  Gene Symbol: MSR1
  Gene Name: macrophage scavenger receptor 1
  ENST ID: ENST00000518960
  CDS Start-End: 160-353
ctcagggttatagaacagccgccttcagctattctcccccagggctctgcagaaccttcccacctttcagcaggctggagtgcagtggcatgatcgtgactcactgcagccttccactcctgggctcaagcaatcctactgcctcaggctcccagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcat

SEQ ID NO: 150466 - DNA, 1009 bp, Homo sapiens
  Payload ID: 9721
  Gene Symbol: MSR1
  Gene Name: macrophage scavenger receptor 1
  ENST ID: ENST00000519060
  CDS Start-End: 59-172
aattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgagaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaagctttctgaaaatatgttaaaaataattaatttcctcctttatatatgtgtcaggaccagtacaactcactgatcatattagggcagggccctcttaagatcaggtgggttgggcgggacatcctctgctaccatctcattaaaaggcccttcacctctggacaagtcatctgcacaactgacttccaagatccttttgtgactcctccaaatgactttggttcccgtgttgtacctgacttccacatggccttctctcctggtccctggtgctgtttgggcctctgctcccatgctcatacctcttcttactccaattactccaccatcacctctctcccctatcacccccagcctggacacctctcatgcacggactggagggctgctccaaccagtcctcagttctctgccacccattgacctagagtcttgaacccaattt

SEQ ID NO: 150467 - DNA, 530 bp, Homo sapiens
  Payload ID: 9721
  Gene Symbol: MSR1
  Gene Name: macrophage scavenger receptor 1
  ENST ID: ENST00000518026
  CDS Start-End: 357-530
atataactacatatgttagcatagaagtggtattgtaattggagataattcctttaccagagatcagtttgcattgttttacgtacttggctatgggtgacttttctgctgataacatattgatgctctgaaagataaccccagaagagtatgaggagacatacacagtctacacagattgcctgttttacttctcaccattgatttatgttgccaaaacaaagagaatgctgaaagtcacctgttctccaaaggtatgtgccaccaaatcaaggaaaagcaatagaaagcagccccaaaatgaagaaccaggtatccttacaggaatatagtgaaccacaaagggctatgtgaaaatgcatttgctgcaagcgggaacatcaggaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaag

SEQ ID NO: 150468 - DNA, 695 bp, Homo sapiens
  Payload ID: 9721
  Gene Symbol: MSR1
  Gene Name: macrophage scavenger receptor 1
  ENST ID: ENST00000522672
  CDS Start-End: 1-450
gaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaaaatccaggaacctcacaacaaggaaagtctttgctatttctaaatgaaggttgtcactatagttcccttgtttcccttgggaaaagatatgaagtttgatcacctatttttgtgtttatgatattctaaaatatctgctcctcgccctcctatagtattgaaaatctctgcattgtatgttgataagtttgtatgtttgtatgtcaagaaaataatgaaccatttagttataatttttcaatggtatgaaaaaatctaagtgacaataaacttgtatctgtcaaaattcaaa

SEQ ID NO: 150469 - DNA, 667 bp, Homo sapiens
  Payload ID: 9722
  Gene Symbol: MST1
  Gene Name: macrophage stimulating 1
  ENST ID: ENST00000448220
  CDS Start-End: 1-586
ggcagggccagcatttctgcggggggtctctagtgaaggagcagtggatactgactgcccggcagtgcttctcctcctgaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttatgcctgta

SEQ ID NO: 150470 - DNA, 2621 bp, Homo sapiens
  Payload ID: 9722
  Gene Symbol: MST1
  Gene Name: macrophage stimulating 1
  ENST ID: ENST00000449682
  CDS Start-End: 363-2540
gaagctggggcaagtaattttccccaatttacagggaaaaaccgaaattcagaaaagtttaatgtcacccaggggctggagcccagacctctggcagctctcactttcacaatgcccttgggctgactaggctgcagaggggtttcaccccaaccccagggcacctcaagtgtccccaccaaaccttcctaacacctgtccactaagctgtactaggcccttgcaactgacctatgggacctgaggcctggcccctcatggctcctgtcaccaggtctcaggtcagggtccagcaggccctgagctgacgtgtggagccagagccacccaatcccgtagggacaggtttcacaacttcccggatggggctgtggtgggtcacagtgcagcctccagccagaaggatggggtggctcccactcctgctgcttctgactcaatgcttaggggtccctgggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccaaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatcccgcatcagcaccgatttacgccagaaaaatacgcgtgcaaagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggcagggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttatgcctgta

SEQ ID NO: 150471 - DNA, 4536 bp, Homo sapiens
  Payload ID: 9723
  Gene Symbol: MST1R
  Gene Name: macrophage stimulating 1 receptor
  Uniprot ID: Q04912
  ENST ID: ENST00000296474
  CDS Start-End: 29-4231
ggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccaaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaa

SEQ ID NO: 150472 - DNA, 4198 bp, Homo sapiens
  Payload ID: 9723
  Gene Symbol: MST1R
  Gene Name: macrophage stimulating 1 receptor
  Uniprot ID: Q04912
  ENST ID: ENST00000344206
  CDS Start-End: 1-4056
atggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccaaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccatta

SEQ ID NO: 150473 - DNA, 854 bp, Homo sapiens
  Payload ID: 9723
  Gene Symbol: MST1R
  Gene Name: macrophage stimulating 1 receptor
  ENST ID: ENST00000434765
  CDS Start-End: 1-854
cacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccc

SEQ ID NO: 150474 - DNA, 4683 bp, Homo sapiens
  Payload ID: 9723
  Gene Symbol: MST1R
  Gene Name: macrophage stimulating 1 receptor
  ENST ID: ENST00000411578
  CDS Start-End: 258-3356
agcggcggctggggcggcaggtgaggcggctggggcgttgctgtcgtgcgtccgcaggcgtcaggtgctcagacccgagggccgggaagggatttgggtttcacaggaacctggggcgggggtccgctatcttggggctgtcgggaccgctgcttaaatttggcccagtccagacctcgagtcgggcccccagccaggcccacgcccaggtccaggcccaggccggtagggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccaaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagctcctcattccctctccccacagcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcac

SEQ ID NO: 150475 - DNA, 810 bp, Homo sapiens
  Payload ID: 9723
  Gene Symbol: MST1R
  Gene Name: macrophage stimulating 1 receptor
  ENST ID: ENST00000440292
  CDS Start-End: 1-810
gtatcaacgtgaccgtgggtggtgagagctgccagcacgagttccggggggacatggttgtctgccccctgcccccatccctgcagcttggccaggatggtgccccattgcaggtctgcgtagatgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctac

SEQ ID NO: 150476 - DNA, 1065 bp, Homo sapiens
  Payload ID: 9723
  Gene Symbol: MST1R
  Gene Name: macrophage stimulating 1 receptor
  ENST ID: ENST00000612032
  CDS Start-End: 1-765
atggagctcctcccgccgctgcctcagtccttcctgttgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagc

SEQ ID NO: 150477 - DNA, 4449 bp, Homo sapiens
  Payload ID: 9723
  Gene Symbol: MST1R
  Gene Name: macrophage stimulating 1 receptor
  ENST ID: ENST00000621387
  CDS Start-End: 265-4149
agtgtacagcggcggctggggcggcaggtgaggcggctggggcgttgctgtcgtgcgtccgcaggcgtcaggtgctcagacccgagggccgggaagggatttgggtttcacaggaacctggggcgggggtccgctatcttggggctgtcgggaccgctgcttaaatttggcccagtccagacctcgagtcgggcccccagccaggcccacgcccaggtccaggcccaggccggtagggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccggttttccaggtacctatccaaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagc

SEQ ID NO: 150478 - DNA, 2025 bp, Homo sapiens
  Payload ID: 9723
  Gene Symbol: MST1R
  Gene Name: macrophage stimulating 1 receptor
  ENST ID: ENST00000613534
  CDS Start-End: 1-1725
atggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagc

SEQ ID NO: 150479 - DNA, 2718 bp, Homo sapiens
  Payload ID: 9724
  Gene Symbol: MAD1L1
  Gene Name: MAD1 mitotic arrest deficient-like 1 (yeast)
  Uniprot ID: Q9Y6D9
  ENST ID: ENST00000265854
  CDS Start-End: 286-2442
gggcgccagctgtccatctgtccatgtgcaactgagactcaattggtggcttgctggtggggatttggtggcatgcttccttgcttccattttttgtctggtaaattggcagcatggctcccagttgccattgaagaatgtggttacaggcatgggtgtattatgagctccaatgtgcgttaggggagtggggctgtccagaggctctgctgactgcacggctgatggcacgtggaaaggctgcccctgaccagtcctttgtctgtccccggaaggaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagctggaggaaagagcagagcagatccgttcgaagtcccacctcatccaggtggagcgggagaaaatgcagatggagctgagtcacaagagggctcgagtggagctggagagagcagccagcaccagtgccaggaactacgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctagac

SEQ ID NO: 150480 - DNA, 2762 bp, Homo sapiens
  Payload ID: 9724
  Gene Symbol: MAD1L1
  Gene Name: MAD1 mitotic arrest deficient-like 1 (yeast)
  Uniprot ID: Q9Y6D9
  ENST ID: ENST00000399654
  CDS Start-End: 330-2486
gcaggtctcgcgagagcgcaggcgcaagtgtcgcgataaatgggcgccggcggagcggagggagatccgagcggcggcggcaagctggctgcgagcggctgaggagctgggatacactcttcctctcctctcctcaacagcagcactccaagctcgccggcctttggtctccaggacttgtcccagcagcccctcgaactgagaattacaccatcggacccctggctctgaggccttcagacttggactgtgtcacactgccaggcttccagggctccaacttgcagacggcctgttgtgggacagtctctgtaatcgcgaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagctggaggaaagagcagagcagatccgttcgaagtcccacctcatccaggtggagcgggagaaaatgcagatggagctgagtcacaagagggctcgagtggagctggagagagcagccagcaccagtgccaggaactacgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctagac

SEQ ID NO: 150481 - DNA, 2355 bp, Homo sapiens
  Payload ID: 9724
  Gene Symbol: MAD1L1
  Gene Name: MAD1 mitotic arrest deficient-like 1 (yeast)
  Uniprot ID: Q9Y6D9
  ENST ID: ENST00000402746
  CDS Start-End: 199-2079
gtcgcgataaatgggcgccggcggagcggagggagatccgagcggcggcggcaagctggctgcgagcggctgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagggtcctgattgtcacgctccttactctggaattatcttatgcgcctcttccttgccaactgtccggcgtcccctacaacacgggtgaccctgtgggcaggtgggctcggccctgcatctggccttgcccctggcacacgaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctagac

SEQ ID NO: 150482 - DNA, 2991 bp, Homo sapiens
  Payload ID: 9724
  Gene Symbol: MAD1L1
  Gene Name: MAD1 mitotic arrest deficient-like 1 (yeast)
  Uniprot ID: Q9Y6D9
  ENST ID: ENST00000406869
  CDS Start-End: 559-2715
gcaaaattttgggaagagtcaacggtgcaagtttgtccgaggaggctgccgtgggcgcggctattccacacattacggcgcgaggcgaaagccttagtggaagcgcgtcctgcgcaaagccggggggcccccgactgcgccttggctcagccttcggttccgagtcctttccgtgcggagtctcccaggggtggcggctccgggtgcggacgcggagtccccaggatcagccggtgcgcagactcggttctttacggcccgattgccacgcaggtctcgcgagagcgcaggcgcaagtgtcgcgataaatgggcgccggcggagcggagggagatccgagcggcggcggcaagctggctgcgagcggctgagcactccaagctcgccggcctttggtctccaggacttgtcccagcagcccctcgaactgagaattacaccatcggacccctggctctgaggccttcagacttggactgtgtcacactgccaggcttccagggctccaacttgcagacggcctgttgtgggacagtctctgtaatcgcgaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagctggaggaaagagcagagcagatccgttcgaagtcccacctcatccaggtggagcgggagaaaatgcagatggagctgagtcacaagagggctcgagtggagctggagagagcagccagcaccagtgccaggaactacgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctagac

SEQ ID NO: 150483 - DNA, 557 bp, Homo sapiens
  Payload ID: 9724
  Gene Symbol: MAD1L1
  Gene Name: MAD1 mitotic arrest deficient-like 1 (yeast)
  ENST ID: ENST00000455998
  CDS Start-End: 124-557
tacaccatcggacccctggctctgaggccttcagacttggactgtgtcacactgccaggcttccagggctccaacttgcagacggcctgttgtgggacagtctctgtaatcgcgaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcagga

SEQ ID NO: 150484 - DNA, 535 bp, Homo sapiens
  Payload ID: 9724
  Gene Symbol: MAD1L1
  Gene Name: MAD1 mitotic arrest deficient-like 1 (yeast)
  ENST ID: ENST00000444373
  CDS Start-End: 294-535
ggattgtggggaagtcttctgatgtagtccctaaagctgacacgccagagcatctcgaggctgttgggggctgttgctgggatcctgaggccgcacacctccctgctatgagttctgacgtttacaaacataggaacgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagctt

SEQ ID NO: 150485 - DNA, 864 bp, Homo sapiens
  Payload ID: 9724
  Gene Symbol: MAD1L1
  Gene Name: MAD1 mitotic arrest deficient-like 1 (yeast)
  ENST ID: ENST00000437877
  CDS Start-End: 499-864
aggctccgtaggatggtgaagaggttgagatgctgtccagcccacagaggccccggaaagccagtgccgcccgtcagaggggtctcctgagtgcgtgtgggtggctggattctgcatactgggttatcttaaccccggctgtgaaaactggatgaagtagcaatcctttcaaccccaagagtctgtgattcagccagagttacaagatgtctcttcatcctctgaggtttacaaggttctcagaaaacctgtgaagagctgcgcggatcctctcctgccccggcccagcggcagggctgccgcctccctctcccctgggcctgagtgggtggatttcccctcccctcctccttcccaggagaagcacagagggagcggccaagcgagccgtgtctgcaaaccccgcttccctctgcggcggcctctgccatcgtgccatggggccggaggtccctggtccagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaag

SEQ ID NO: 150486 - DNA, 850 bp, Homo sapiens
  Payload ID: 9724
  Gene Symbol: MAD1L1
  Gene Name: MAD1 mitotic arrest deficient-like 1 (yeast)
  ENST ID: ENST00000450235
  CDS Start-End: 53-850
caccgtgagcctgtgcatctgttgctattcaggagatggaagtgacaaaaaaatgagagaacttgagtttgcaaagttagagtgctgtctggcctggcagcttcaggcttccaggagagagctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccag

SEQ ID NO: 150487 - DNA, 555 bp, Homo sapiens
  Payload ID: 9724
  Gene Symbol: MAD1L1
  Gene Name: MAD1 mitotic arrest deficient-like 1 (yeast)
  ENST ID: ENST00000429779
  CDS Start-End: 85-555
gtcgcgataaatgggcgccggcggagcggagggagatccgagcggcggcggcaagctggctgcgagcggctgaggaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagctggaggaaagagcagagcagatccgttcgaagtcccacctcatccaggtggagcgggagaaaatgcagatggagctgagtcacaagagggctcgagtggagctggagagagcagccagcaccagtgccaggaactacgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgag

SEQ ID NO: 150488 - DNA, 564 bp, Homo sapiens
  Payload ID: 9724
  Gene Symbol: MAD1L1
  Gene Name: MAD1 mitotic arrest deficient-like 1 (yeast)
  ENST ID: ENST00000421113
  CDS Start-End: 440-564
tgacagggtgggaaagacgtcactgggggccaggcagggccttaccaggaggcagcatctgagcagaggcctgagggcagccgggggctgggcaggggtgaccaagcgggacagacgagctgctgggacgccagcagggctggcacagtgcggggatcacagcatgattgcagcgggcagctgttgaagactggaagcgcggcagtggcatggttacctcacacagtcggaagagcgacctggagaaagaggccttcgggatggggagcaggaagtgtgtcgcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagat

SEQ ID NO: 150489 - DNA, 831 bp, Homo sapiens
  Payload ID: 9724
  Gene Symbol: MAD1L1
  Gene Name: MAD1 mitotic arrest deficient-like 1 (yeast)
  ENST ID: ENST00000445959
  CDS Start-End: 215-831
cagcctctctcagaaggcggccacctctgtcacagctctcctgggttttgggctggagtaccctggatgaggacagcacaagctcgtactccacccggggctccgggagtgcttggtgcttcccgaggaaggcaggcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcag

SEQ ID NO: 150490 - DNA, 750 bp, Homo sapiens
  Payload ID: 9724
  Gene Symbol: MAD1L1
  Gene Name: MAD1 mitotic arrest deficient-like 1 (yeast)
  ENST ID: ENST00000429625
  CDS Start-End: 112-750
gatgccgtcactgaggattctgtttttctttgggtgcgacctgctcagctggaggaaagagcagagcagatccgttcgaagtcccacctcatccaggtggagcgggagaaaatgcagatggagctgagtcacaagagggctcgagtggagctggagagagcagccagcaccagtgccaggaactacgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaa

SEQ ID NO: 150491 - DNA, 839 bp, Homo sapiens
  Payload ID: 9724
  Gene Symbol: MAD1L1
  Gene Name: MAD1 mitotic arrest deficient-like 1 (yeast)
  ENST ID: ENST00000438959
  CDS Start-End: 243-839
ggacgcacggatggtctccttctctctgacctcgggagacggtagatgtgtccaggacacctgctgtgcctctctgcgtcactccaggcaccggattatcttctgtggcttctcttttttctccaagtcagagctggagggcatggggcggttgtttagtagagcctggggaggtgacttgcccccttgtctctgcagttctcatttcctaatctccagcagcctggggcggaagtgaatttatggtctccctgcggccgtgcttgccggggctccccacccagcatttggaggagccctgcccaggcgattacagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcag

SEQ ID NO: 150492 - DNA, 5468 bp, Homo sapiens
  Payload ID: 9725
  Gene Symbol: MAD2L1
  Gene Name: MAD2 mitotic arrest deficient-like 1 (yeast)
  Uniprot ID: Q13257
  ENST ID: ENST00000296509
  CDS Start-End: 341-958
ggaatcgtcatcttcttccctcggccccaactagtagaccacgaccagaagacacatcctaacctacacctaccgtagtgtcacacccggcacagcgcgaccaggtccaccaactgcgcctgcgcgaaccggccgctcccgcgacatcacaggaaggctgagagaaagggcaggtccccgctgcgtggggctgggcttaaaggctcgtcgcgcctgcgcaaaggacctgacgacgtgctgcgtcgttacttttgaaacgcttggcggggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagattggttatacaagtgttcagttcagaaactggttgtagttatctcaaatattgaaagtggtgaggtcctggaaagatggcagtttgatattgagtgtgacaagactgcaaaagatgacagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaagtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaatttgtcttaaaacattttgatactggtttggtgttgatatagttaaatggtaattagaattgattcagcatagctaatgaattcttgttcctacgaagttatagaacttaagggtccaaagttgagtgagtcttgaggtgtcttcaatctaatggataaactttgatcacatcctgttcatctcatagcaatagacttaaggctattacttcatcattgtgaaaagataaatgtcctttggaattagtccaacaattccagttgaacaagtgttgattttagtactttactatactcttagccttattgtcagcctacttttccttatatacttaaatactatgcttattcctgtgctttcattaataccctcatctggtacatgctttctatccagttctcacctgtttttccaaggtcagtttaaggcagatttgtaaagtcttctctaatctctaatctaaatctgacctcattttgtaaaaattcagtttattaatgtttattattagacactaagttctttatgtgtattaacttatttaaccttcactatttttaagtaattgcacatagtctgaatctgttcattcagaaattacatattgagcaaatactgtggatcagtggcagtttctgggttctcagtgacaaatttgtagactcttcatatctttatggaataagtggaccactggtgttaccaacctagatgatttcaagaaaagtggcaattaaatgcttcatttgtattttaactatttgagaagtcagactaaattctgcgaaatcacttttcccccccaagatggagtcttattctgtcgcccaggctggagtacagtgacgcagctcagctcactacagcctctgcctcccggattccagccattcttccgtctcagcctcctgagtagctgggattacaggcacgtgccaccacacctggctaatttttatatttttagtagagagagggtttcaccatgttggccaggctagtcttgaactcctgacctcatgatctgcccgccttgacctcacaaagcattgggattacaggcgtgagccactgcgcccggctgaaatcacatttttaaaggttgtgtgtatactctggtcatttcaactcagctaccaatattaacaggattaaattcttagatttttgtatcatttgcatgctactatttactctgaggtttctggagagctagtcatgatgagtcattttaccccttacagattatataatcaattaagaaatacacattttgggctgggcgcagtggctcgcgcctgtaatcccagcactttgggaggccgaggcaggtggatcacgagatcaggagtttgagaccagcctggccaagatggtcaaaccccgtctctactaaaaatataaaaattagctgggcgtggtggcgggcgcatctcagctacttgggaggctgaggcaggagaaatcgcttgaacccatgaggtggaggttgcggtgagccaagaccgtgccactgtactctagcctgggcgacagagcaaggctccatctcaaaaaataataaataaaaaagaaatacacattttggagctgagtgggagccaaactatgagttttattgaggtgaagctatactggaaaagctttgccctgtagctccaagtggactgtcccatcctctttctagaccttgaggcttacctcaggaggatgatgtttaaatcaacagctgaaagacttgtgagtggtttctacaccatgttaaagagaaggttctaagacagcatgataggcctctaggcctggcctggactctggctcagtgttgcttaccatatgtagaggatgaacagaggttaagcccatcaaggtctgaagtagagcccaggaggaactgaactgtatctggctttcaggatccttttcccagtgtcatcaatcagagaagtcaaacctctgtgagaatgcttgtgcagaggtataacagtctcatgtattggttggcttttgctgcacctttctcattctgttggagggacattggttagtcaggactctgaaggccagctttttcacactgaccaaagcaagtgaaggtcaagcctaactttaatgggaccaggaagtatactcctcccatggaggtggtgggaatggcaccgagaagtttgatgacagttatctaatggactagaggttggcaaactttctgtaaatggccaggtagtaaatagttctgcttttgaaggcatatggtctcttgcacctactcgaggctgaaagcagctatagacaatacataaatgaatgagcgtgagtgtgttccaataagaaaaaaacatggctgtttgcttcggccccagggttgtagcttaccagtcctgtaacagatcacagtttgctcttttggtcacaaatacttgaacccctccctagttcagagcatttgataccgtaatatttaaagctcacttgtaaaacatcgtttgttgcctccatccatagtatctcaaacagaatgtctctcccaaatatacctaaattccatattctctgaagcacaaccagctattttcttgacatacttcctaacacaccccacagttcacaatttgatctgaaaacttgttaagggaggttctttggcatgtgatgccataaaaagagaggtatgggctctcctttaaaaaagagaccctttttatgagactcacaataggataaagagcccatgcctatttttaatcattttttcactatatagacatgcatgctgaaaaatgtttttattagtataatgctaattatactgacttcctatatattttagcatatagattcaaagattattagcacaataaggtagataacttcatagaccatttcttcatcttgttttcatttagtatgtaaaatttatctaaaatttacatgaaagatcagaatagctatgtaatgctactttgtaactcttatattttccaccagatgtcactaatgctgtaatattcaaattaagatgactttcttttggttctaaaggctgtaagcttattggaaaagcaaggttactcagcattggaattcctggcaacaaatatataaatacattaggggaataaacacttagcatttattatttactagtcacttcacatgaatttttatttaattctcatgcttttgtgcacaagtaaaactgggggtcaatgggcatgcaaattgtgtcgtggtttttgaagtttagtggtctctcctatccctggccaaggaagtatgcaaattgtattgtggtttttgaagtttaggtgatctcttccttctatccctagccaaggaagttcatcctgactccccaacaagcatatcaaaaggagtgtttcgtcacctttttcctcttaccctttacatccttttagcaataaagtgttcagaacaaactggttttcctttactgtgctttgcaaaacttattcatgttttattgggtgactttgtatttacactttcctcagatagtctgttgtcagatgactttgaccaatgattgggaggaaccaaatacagaggattttatcctatgcctaatctatattgtctacagagtaaatcaggtatgaatttgtgaacagtaatgaaacaattttccaactaatcagaagaattgtttgttaagtaaccttaattactcagtttttggtgaattgtttgcggcttaacttgtaaataatttcttattctttttttaaatgtatgaaatatttctagttattttgttcaatgtgactgataaaagtttatattggaatagctgtgaaatggaaa

SEQ ID NO: 150493 - DNA, 1277 bp, Homo sapiens
  Payload ID: 9725
  Gene Symbol: MAD2L1
  Gene Name: MAD2 mitotic arrest deficient-like 1 (yeast)
  Uniprot ID: Q13257
  ENST ID: ENST00000333047
  CDS Start-End: 100-372
gtcgttacttttgaaacgcttggcggggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaagtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgtttt

SEQ ID NO: 150494 - DNA, 764 bp, Homo sapiens
  Payload ID: 9725
  Gene Symbol: MAD2L1
  Gene Name: MAD2 mitotic arrest deficient-like 1 (yeast)
  ENST ID: ENST00000504707
  CDS Start-End: 125-250
cgcaaaggacctgacgacgtgctgcgtcgttacttttgaaacgcttggcggggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttcttgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaagtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaa

SEQ ID NO: 150495 - DNA, 1860 bp, Homo sapiens
  Payload ID: 9726
  Gene Symbol: MAD2L2
  Gene Name: MAD2 mitotic arrest deficient-like 2 (yeast)
  Uniprot ID: Q9UI95
  ENST ID: ENST00000235310
  CDS Start-End: 930-1565
gaggaggggcggcgggtggcgggctcgactgcccccagccgaggggcagccccggggccgggcccggcgcgcacccggccagcgcgccctcgccagctgcgctctgagttctgggccagctccccagaggcctaggcgccgccgccgcgagggcgcggggcagacaaaggaggcagacaaaggcgggcgcagcccagcagccgtgcgggcaccgggcgaggcaggcccactcctcccgtaatatcatctctgagggcccttacaggacttccagaccgagtccacgcccctgggggacttgggagcagtaaaatgtagtggcaggaggcacctcggccatcgcccaccccaccagctgggagactcgggcaggttattcacccttctgcacctcgcttgacttatctgtataaagagaacagtcacagtaactgcctcatggagttactcccaggactgagataatccacggacacacttagcccagtgcccagcactcggctggagctccaaaaagccctcttccggcgcctgctaaagcgagagaaatgccctcgggggaagatatgtagcgatccaatggaacgtggagatcaacgttgtgttttcttcgcgcccacccgaagttgaagggaggtggcgcggcgggtctcagcccctcccggacgccgaggcccggcccccgcccctcggagacccgcccccgcatgcggaaccgccctctgcgaggcccggtttgggccgtgcgggaatgggcgtggcctgggcggggcgggcgctaggacccaccggagcgccgtgaacgtcaccgagcggcgccgaggccccgggttgagcgggaggcgcgatcggtccggtcggtggctccccgcggcggggccgggcccgatctcgggcgggaaccgagcgcagagccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggctgggctga

SEQ ID NO: 150496 - DNA, 872 bp, Homo sapiens
  Payload ID: 9726
  Gene Symbol: MAD2L2
  Gene Name: MAD2 mitotic arrest deficient-like 2 (yeast)
  Uniprot ID: Q9UI95
  ENST ID: ENST00000376667
  CDS Start-End: 210-845
aggggcagccccggggccgggcccggcgcgcacccggccagcgcgccctcgccagctgcgctctgagttctgggccagctccccagaggcctaggcgccgccgccgcgagggcgcggggcagacaaaggaggcagacaaaggcgggcgcagcccagcagccgtgcgggcaccgggcgaggcaggcccactcctcccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcc

SEQ ID NO: 150497 - DNA, 864 bp, Homo sapiens
  Payload ID: 9726
  Gene Symbol: MAD2L2
  Gene Name: MAD2 mitotic arrest deficient-like 2 (yeast)
  ENST ID: ENST00000376669
  CDS Start-End: 93-767
gggaggcgcgatcggtccggtcggtggctccccgcggcggggccgggcccgatctcgggcgggaaccgagcgcagagccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcaggtgggctgcccctgcccctcgcccactagctggcatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctct

SEQ ID NO: 150498 - DNA, 1002 bp, Homo sapiens
  Payload ID: 9726
  Gene Symbol: MAD2L2
  Gene Name: MAD2 mitotic arrest deficient-like 2 (yeast)
  ENST ID: ENST00000376672
  CDS Start-End: 78-752
cagacaaaggcgggcgcagcccagcagccgtgcgggcaccgggcgaggcaggcccactcctcccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcaggtgggctgcccctgcccctcgcccactagctggcatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatact

SEQ ID NO: 150499 - DNA, 1118 bp, Homo sapiens
  Payload ID: 9726
  Gene Symbol: MAD2L2
  Gene Name: MAD2 mitotic arrest deficient-like 2 (yeast)
  Uniprot ID: Q9UI95
  ENST ID: ENST00000376692
  CDS Start-End: 189-824
ccgtgcgggaatgggcgtggcctgggcggggcgggcgctaggacccaccggagcgccgtgaacgtcaccgagcggcgccgaggccccgggttgagcgggaggcgcgatcggtccggtcggtggctccccgcggcggggccgggcccgatctcgggcgggaaccgagcgcagagccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggctgggctg

SEQ ID NO: 150500 - DNA, 1032 bp, Homo sapiens
  Payload ID: 9726
  Gene Symbol: MAD2L2
  Gene Name: MAD2 mitotic arrest deficient-like 2 (yeast)
  ENST ID: ENST00000456915
  CDS Start-End: 531-1032
ccccgggttgagcgggaggcgcgatcggtccggtcggtggctccccgcggcggggccgggcccgatctcgggcgggaaccgagcgcagagccggtactgggggaggggagagggggcgggattcccgccgggagggatccggcgtagcagggggcggagtcttattccaaccccgcttcgctttccgcatgtcccgctttgcgctcccggccctgggcatcccgctgtttccctctgcgtccgcggccctgcccttttcgggggcacagctgtggtctttccaccccgcgagacagcggggcgagggggcgcgggcggccagtggatagaggctgatgcccccaagcacggacgccagcgtgggggtggaggttcttccagctgccctgagcctgtgcgaagcgggaggtccttccccagttcccacagactgtggggagggaagagacggtggaagcgagcgggttctgggctcctgggtctctggaactaccctctgcccttgccccaacactcaggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaagg

SEQ ID NO: 150501 - DNA, 678 bp, Homo sapiens
  Payload ID: 9726
  Gene Symbol: MAD2L2
  Gene Name: MAD2 mitotic arrest deficient-like 2 (yeast)
  ENST ID: ENST00000445656
  CDS Start-End: 86-678
gcgatcggtccggtcggtggctccccgcggcggggccgggcccgatctcgggcgggaaccgagcgcagagccggtagcgggaaggatgaccacgctcacacgacaagacctcaactttggccaaggtagggaggctggacctgcgggcccgggggcgggggcgtctgggccggcgggcttcctcgagcgcgccaccggcttgtgcccccctgcagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggt

SEQ ID NO: 150502 - DNA, 1301 bp, Homo sapiens
  Payload ID: 9727
  Gene Symbol: MAD2L1BP
  Gene Name: MAD2L1 binding protein
  Uniprot ID: Q15013
  ENST ID: ENST00000372171
  CDS Start-End: 58-882
atgatgccccgcgagacctttattctaaccgcaaggagtagcggaggggaggtcgtgatggcggcgccggaggcggaggttctgtcctcagccgcagtccctgatttggagtggtatgagaagtccgaagaaactcacgcctcccagatagaactacttgagacaagctctacgcaggaacctctcaacgcttcggaggccttttgcccaagagactgcatggtaccagtggtgtttcctgggcctgtgagccaggaaggctgctgtcagtttacttgtgaacttctaaagcatatcatgtatcaacgccagcagctccctctgccctatgaacagcttaagcacttttaccgaaaaccttctccccaggcagaggagatgctgaagaagaaacctcgggccaccactgaggtgagcagcaggaaatgccaacaagccctggcagaactggagagtgtcctcagccacctggaggacttctttgcacggacactagtaccgcgagtgctgattctccttgggggcaatgccctaagccccaaggagttctatgaactcgacttgtctctgctggccccctacagcgtggaccagagcctgagcacagcagcttgtttgcgccgtctcttccgagccatattcatggctgatgcctttagcgagcttcaggctcctccactcatgggcaccgtcgtcatggcacagggacaccgcaactgtggagaagattggtttcgacccaagctcaactatcgagtgcccagccggggccataaactgactgtgaccctgtcatgtggcagaccttccatccgaaccacggcttgggaagactacatttggttccaggcaccagtgacatttaaaggcttccgcgagtgaatgagtgcttcttaatcctaaaaacacaatggctgaattatctttctccatgtggcgctgaatcacccatctggtttggagctagagttgcttcctggtgagagaggaagcaactctccttctggttgtctgcctcccctcagatttcctgataggctgatggcatgtggctgtgactgtgactgtaatcattgctgaacaacatctctttgaatcaaaggttgattttcccagagggtgctgggtcaggcatttctattaggagttggaaagcaaaaatgggtccatagacactctatggaggtgtccctttctgctctttgctgtgtcctttcagaatttttaccaggaacataatgtggatgtgacttatgaacttaaatataaaataaatagattcttattatattttcctgaaa

SEQ ID NO: 150503 - DNA, 1517 bp, Homo sapiens
  Payload ID: 9727
  Gene Symbol: MAD2L1BP
  Gene Name: MAD2L1 binding protein
  Uniprot ID: Q15013
  ENST ID: ENST00000451025
  CDS Start-End: 211-1131
gggggaatttagagcctcgaggcctggggtggggacgcgaggacaccagcgtagaagagcttacatcagaatcgagctttgtgggcgctccgggatttggccctttagcgcggatcctagacaacaggttttggacctcgagagctgcagaactgaggctactggtgccgccagcctgctggctccgcctctgcctcagtttcttcccctatggcccgcgtgccgctggggcggagtctcactctgtcacccaggctggagcacaatggcatgacctcagctcaccacaacttccgcctcccaggttcaagggattctcctgcctcagcctcccaagtagctgagattatagatttggagtggtatgagaagtccgaagaaactcacgcctcccagatagaactacttgagacaagctctacgcaggaacctctcaacgcttcggaggccttttgcccaagagactgcatggtaccagtggtgtttcctgggcctgtgagccaggaaggctgctgtcagtttacttgtgaacttctaaagcatatcatgtatcaacgccagcagctccctctgccctatgaacagcttaagcacttttaccgaaaaccttctccccaggcagaggagatgctgaagaagaaacctcgggccaccactgaggtgagcagcaggaaatgccaacaagccctggcagaactggagagtgtcctcagccacctggaggacttctttgcacggacactagtaccgcgagtgctgattctccttgggggcaatgccctaagccccaaggagttctatgaactcgacttgtctctgctggccccctacagcgtggaccagagcctgagcacagcagcttgtttgcgccgtctcttccgagccatattcatggctgatgcctttagcgagcttcaggctcctccactcatgggcaccgtcgtcatggcacagggacaccgcaactgtggagaagattggtttcgacccaagctcaactatcgagtgcccagccggggccataaactgactgtgaccctgtcatgtggcagaccttccatccgaaccacggcttgggaagactacatttggttccaggcaccagtgacatttaaaggcttccgcgagtgaatgagtgcttcttaatcctaaaaacacaatggctgaattatctttctccatgtggcgctgaatcacccatctggtttggagctagagttgcttcctggtgagagaggaagcaactctccttctggttgtctgcctcccctcagatttcctgataggctgatggcatgtggctgtgactgtgactgtaatcattgctgaacaacatctctttgaatcaaaggttgattttcccagagggtgctgggtcaggcatttctattaggagttggaaagcaaaaatgggtccatagacactctatggaggtgtccctttctgctctttgctgtgtcctttcagaatttttaccaggaacataatgtggatgtgacttatgaacttaaatata

SEQ ID NO: 150504 - DNA, 1831 bp, Homo sapiens
  Payload ID: 9728
  Gene Symbol: MAEL
  Gene Name: maelstrom spermatogenic transposon silencer
  Uniprot ID: Q96JY0
  ENST ID: ENST00000367870
  CDS Start-End: 265-1476
tgccacgcacccagccaatcagagcacttggcacctgcgacggcgctctccccccacctcacccgcaaggcggcacgagccggaatcttccagtctcaggctgtttgttcccccgcggggcaatgcgactgcgcgtcgcttcctgattggccgagagttgcgggctgcgtgcgcaggcgcctacctctgttacttagggcgggagcccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataaccaagcaactgtgttacaaaacctttatagatttattcatcccaacccagggaactggccacctatctactgcaagtctgatgatagaaccagagtcaactggtgtttgaagcatatggcaaaggcatcagaaatcaggcaagatctacaacttctcactgtagaggaccttgtagtggggatctaccaacaaaaatttctcaaggagccctctaagacttggattcgaagcctcctagatgtggccatgtgggattattctagcaacacaaggtgcaagtggcatgaagaaaatgatattctcttctgtgctttagctgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccagaagctaagggttgggagttcaggattctctcatttcaactcttctaatgaggaacaaagatcaaacacacccattggtgactacccatctagggcaaaaatttctggccaaaacagcagcgttcggggaagaggaattacccgcttactagagagcatttccaattcttccagcaatatccacaaattctccaactgtgacacttcactctcaccttacatgtcccaaaaagatggatacaaatctttctcttccttatcttaatgatggtactcttttcaatttctgaaaacagtaacaggcccaacttccttcttactacagtcatattaaacagatcacatcaatgacaaatgtcactactataaaaactacttaatttgtaaggaaattgtttcatagatttaaaaaaattgtggttggagagcatcttggcatttgtgctttttttcttgagggattgttctgcttcctggctgtatgatgggtatatcattaaagtttggagtcctatatgaacaaaactgacatttttagagttgtacttttgggaatgttatagattgatcattctttctcctgataataaaggtattgaatatctgttatgaaaggttct

SEQ ID NO: 150505 - DNA, 1908 bp, Homo sapiens
  Payload ID: 9728
  Gene Symbol: MAEL
  Gene Name: maelstrom spermatogenic transposon silencer
  Uniprot ID: Q96JY0
  ENST ID: ENST00000367872
  CDS Start-End: 245-1549
agagcacttggcacctgcgacggcgctctccccccacctcacccgcaaggcggcacgagccggaatcttccagtctcaggctgtttgttcccccgcggggcaatgcgactgcgcgtcgcttcctgattggccgagagttgcgggctgcgtgcgcaggcgcctacctctgttacttagggcgggagcccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgcttctgagggaggaagaaaaggagaaatacgcagaaatggctcgagaatggagggccgctcagggaaaggaccctgggccctcagagaagcagaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataaccaagcaactgtgttacaaaacctttatagatttattcatcccaacccagggaactggccacctatctactgcaagtctgatgatagaaccagagtcaactggtgtttgaagcatatggcaaaggcatcagaaatcaggcaagatctacaacttctcactgtagaggaccttgtagtggggatctaccaacaaaaatttctcaaggagccctctaagacttggattcgaagcctcctagatgtggccatgtgggattattctagcaacacaaggtgcaagtggcatgaagaaaatgatattctcttctgtgctttagctgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccagaagctaagggttgggagttcaggattctctcatttcaactcttctaatgaggaacaaagatcaaacacacccattggtgactacccatctagggcaaaaatttctggccaaaacagcagcgttcggggaagaggaattacccgcttactagagagcatttccaattcttccagcaatatccacaaattctccaactgtgacacttcactctcaccttacatgtcccaaaaagatggatacaaatctttctcttccttatcttaatgatggtactcttttcaatttctgaaaacagtaacaggcccaacttccttcttactacagtcatattaaacagatcacatcaatgacaaatgtcactactataaaaactacttaatttgtaaggaaattgtttcatagatttaaaaaaattgtggttggagagcatcttggcatttgtgctttttttcttgagggattgttctgcttcctggctgtatgatgggtatatcattaaagtttggagtcctatatgaacaaaactgacatttttagagttgtacttttgggaatgttatagattgatcattctttctcctgataataaaggtattgaatatctgttatgaaaggttctaaaa

SEQ ID NO: 150506 - DNA, 1013 bp, Homo sapiens
  Payload ID: 9728
  Gene Symbol: MAEL
  Gene Name: maelstrom spermatogenic transposon silencer
  ENST ID: ENST00000447624
  CDS Start-End: 66-1013
cgggagcccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataaccaagcaactgtgttacaaaacctttatagatttattcatcccaacccagggaactggccacctatctactgcaagtctgatgatagaaccagagtcaactggtgtttgaagcatatggcaaaggcatcagaaatcaggcaagatctacaacttctcactgtagaggaccttgtagtggggatctaccaacaaaaatttctcaaggagccctctaagacttggattcgaagcctcctagatgtggccatgtgggattattctagcaacacaaggtgcaagtggcatgaagaaaatgatattctcttctgtgctttagctgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccag

SEQ ID NO: 150507 - DNA, 1700 bp, Homo sapiens
  Payload ID: 9728
  Gene Symbol: MAEL
  Gene Name: maelstrom spermatogenic transposon silencer
  ENST ID: ENST00000622874
  CDS Start-End: 206-1342
accgcctcccgcgcctccgccccgccgcccgctgccgcgactgccaaagtttctcggtcacgtgctggcccccggcggcccaaaggagaagatccccgaactacggcgacgaggcctgcctgtggctcgcgttgctgatgccatcccttactgctcctcagactgggcgcttctgagggaggaagaaaaggagaaatacgcagaaatggctcgagaatggagggccgctcagggaaaggaccctgggccctcagagaagcagaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataaccaagcaactgtgttacaaaacctttatagatttattcatcccaacccagggaactggccacctatctactgcaagtctgatgatagaaccagagtcaactggtgtttgaagcatatggcaaaggcatcagaaatcaggcaagatctacaacttctcactgtagaggaccttgtagtggggatctaccaacaaaaatttctcaaggagccctctaagacttggattcgaagcctcctagatgtggccatgtgggattattctagcaacacaaggtgcaagtggcatgaagaaaatgatattctcttctgtgctttagctgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccagaagctaagggttgggagttcaggattctctcatttcaactcttctaatgaggaacaaagatcaaacacacccattggtgactacccatctagggcaaaaatttctggccaaaacagcagcgttcggggaagaggaattacccgcttactagagagcatttccaattcttccagcaatatccacaaattctccaactgtgacacttcactctcaccttacatgtcccaaaaagatggatacaaatctttctcttccttatcttaatgatggtactcttttcaatttctgaaaacagtaacaggcccaacttccttcttactacagtcatattaaacagatcacatcaatgacaaatgtcactactataaaaactacttaatttgtaaggaaattgtttcatagatttaaaaaaattgtggttggagagcatcttggcatttgtgctttttttcttgagggattgttctgcttcctggctgtatgatgggtatatcattaaagtttggagtcctatatgaacaaaactgacatttttagagttgtacttttgggaatgttatagattgatcattctttctcctgataataaaggtattgaatatctgttatgaaaggttctaaa

SEQ ID NO: 150508 - DNA, 5166 bp, Homo sapiens
  Payload ID: 9729
  Gene Symbol: MRO
  Gene Name: maestro
  Uniprot ID: Q9BYG7
  ENST ID: ENST00000256425
  CDS Start-End: 203-949
attcatattcacccttcatgaggatgagcacagagcaagaagctagccacgctgggctcctcattgcctagctcaggaattcagggctgggaaaatttagccgagtcatcacatttggctactacccgggaaagcagccctcccgagtcaggaacgggctccggttcatcacgtggcagccgcctgcaggagccgcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgagaacgacagtctgagatactcggcctttgttttgtttgggcaattggctgcctttgccgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgtttttttgttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatgctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccagataactcagtaaacagtggagctggaattcaaacatgtacggtctgacttcttgagcccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttattaattactttttggctattaatgtcaattattttggtgatcaatcctagttatccaaggagtcacatcactcgtaaaaattacaagaaaaatctctaagtccctctcaccctccctctaaccagattgcatcccaagcttctatagaaactctggtaccacccctgaattcagtatccaggccacacccggagcgttttgttcaagacaatttaaaacacgggggattataaaagctatagctggatcttaagtggcattctgagaatgaggaactcaattttctgctgtagctcccagggacagggtggtgtgacacagatgcggggatgaggagagacctaggcgagatgaggatgtgggagatggcagacagagtggcaagtgccaggcaggaatggattttcttccttcctgttctgaatctgaagaacatgacagcaagagattttaggagggacacaggctcacgagcaaatgggtggttctgagctgtaagccccctgcccctccctagcacccactccccggatgctggcctctttgaaattttgttgcaaggttggtttaaacttgatgcagttccattaagtgatcagtgagtggtctgagaaatggctgcatgtggctggcattcaaaaaggtggggatagggtgagatgggtggggttacgtgctctggagtagaaaaacctatgcagttaatgtccctctgtcggttaaaattgtggaagatgcggttggattatttgactttaagattcaatggtaggcttttattttggtggcccccaatgagtcatgcctcctgatactcatgtctttatttagtcccttctgtttgaatctgggctgcctttgtgacttgctttaatcaggagattgtgataaatggcactgtgccgggcatagaaaccctggcagtttcctcgtttgaattgtgggggaagccagctgccacataaggagttgaactaccaggaacaaatgagagtgcctgagatcaccatgtgaaggagaacggagacacccaacccacagcagagtctgaggcccggacacatgacacaagttgtcccttccagccagacccgagctgttgaagctactccagctgacaccatacggaaaagagacgagcgtctccatcaagcctgtgtcagttgcagaagcatgaacaaagaatcaaatgattgttgttttaagtcattaacctttgggataatttgtcacactgcaataagtaaccagagaagattccttattattaactgttgtcttggctaattttgttttgctcttcataagtcctctttgagtttaaattctatttccagaaatttatgttatcatgaaatttggtggcaagagcaagggactatgtttttttgtttgtttgtttctgtttctcaccatacctaccacagagcctggccatgtgattaaggaacatttgctgaatgactaaatgattccaaattgtagagggaataaagtccaatgtccagtctgccatttcaggctttcaaccttcgttttcttctgttactctctttgcttcagacaagtttgggtcctttctcttctctcaacatgtcttgttctcctataccccctcacctttgctcagtctgctatttctgtgttgagtcccctccctgctcacctgtacacacccacctggaatcacatgcacacacacacacacacatttcacgtgtatctcttatctgtactccaatgcctaggtcaaagtcctgatccccccaatcaggggagagctcaagtctctgaattcccagaacattctagcaatattataccacttatatcttatctgaaaagtttttttttgtatatggctttatgtttttttttttatcctgttagattgaaactacagaaggcagggctgtatcttgtacatcattgtatctccccggtgactgcaaaagtactctgtaaatgaatgttgattagggggaaaaatgtcagaaagtcatctgaagctgtcattccttactgggaggagcccattttgacaaatgagggtcaccaatttcattccttataaccaatgtacaggttacttttatgcttgtgcatttcaagtttccccttccccacgtttatctgaatgccaacccaaaggtaatgttttgacatttcttaattttgaacattaattttgaaccttattgagcagttgaatgaaagaaagaaaaaaggaatgttcaagtgccccgaccctcatgctaagtgcccagggtagagctttgcttggtccctgtgtctctggtgctcatgagataggtctttctttctttatttttatttttgagatggagcctcactctgtcacccaggctggagtgcaatgacacgatctcggctcactgcaacctccacctcctgggttcaagcgattctcctgtctcagcctcctgagtagctgggattacaggtgcctgccaccatggctggctaatttttgtgtttttagtagagacggggtttcaccatgttggccaggctggtctcaaactcctgacctcaagtgatctgctcaccttggtctcccaaagtgctgggattacaggcgtgagccaccgctcctggctgagataggtctttcttaaaggggagagggaagtggtggagagagaggagagaaaatgacaaaggaggaggctgagaatctaacaggtgtgaccaattctgctactgaatgagagcagaagcctgtgaacttccagttaatagaccacttaattgggggaacgcttcacacgttataaaaaagcactagaatgttttgaaagcgagaaacaacagctgtgtagggtagctagcagttagtgttgtacagaagacagatatttgtgcatttctgcattttctaagtttgctgcaatgagcatgtattactttcatagttataaaacacatgcaaaatgcccttttaaaatgaaaaaaaagtccatgagtgtaagtgatatatatgctttggaaagcctgggacggtcattgtttactctcaatagtatgtgtttgcctttgtctttttgagacattttgttttaatctgttgatgacaataacctgttgataatataacttgataacaaataaaatgacttatgattgattatcatttta

SEQ ID NO: 150509 - DNA, 951 bp, Homo sapiens
  Payload ID: 9729
  Gene Symbol: MRO
  Gene Name: maestro
  Uniprot ID: Q9BYG7
  ENST ID: ENST00000398439
  CDS Start-End: 159-905
aaaacacctcagcatggcgtggggaagcaaaggaattcagggctgggaaaatttagccgagtcatcacatttggctactacccgggaaagcagccctcccgagtcaggaacgggctccggttcatcacgtggcagccgcctgcaggagccgcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgagaacgacagtctgagatactcggcctttgttttgtttgggcaattggctgcctttgccgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagc

SEQ ID NO: 150510 - DNA, 1657 bp, Homo sapiens
  Payload ID: 9729
  Gene Symbol: MRO
  Gene Name: maestro
  Uniprot ID: Q9BYG7
  ENST ID: ENST00000431965
  CDS Start-End: 150-782
aacgggccttggcagggaggttttgtttggtgcagaggaaaggtccccagaattgccatctgcagaatttctgcagaaagtgtcgaccaggctggcatgagggaagaaggaggggaaatcacagcaaggagaaggaaaaacacctcagcatggcgtggggaagcaaaggaattcagggctgggaaaatttagccgagtcatcacatttggctactacccgggaaagcagccctcccgagtcaggaacgggctccggttcatcacgtggcagccgcctgcaggagccgcaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgtttttttgttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatgctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccagataactcagtaaacagtggagctggaattcaaacatgtacggtctgacttcttgag

SEQ ID NO: 150511 - DNA, 1125 bp, Homo sapiens
  Payload ID: 9729
  Gene Symbol: MRO
  Gene Name: maestro
  Uniprot ID: Q9BYG7
  ENST ID: ENST00000436348
  CDS Start-End: 150-938
aacgggccttggcagggaggttttgtttggtgcagaggaaaggtccccagaattgccatctgcagaatttctgcagaaagtgtcgaccaggctggcatgagggaagaaggaggggaaatcacagcaaggagaaggaaaaacacctcagcatggcgtggggaagcaaaggaattcagggctgggaaaatttagccgagtcatcacatttggctactacccgggaaagcagccctcccgagtcaggaacgggctccggttcatcacgtggcagccgcctgcaggagccgcaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgagaacgacagtctgagatactcggcctttgttttgtttgggcaattggctgcctttgccgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaa

SEQ ID NO: 150512 - DNA, 1966 bp, Homo sapiens
  Payload ID: 9729
  Gene Symbol: MRO
  Gene Name: maestro
  Uniprot ID: Q9BYG7
  ENST ID: ENST00000428869
  CDS Start-End: 260-1006
agagatgtttctagattgattcatattcacccttcatgaggatgagcacagagcaagaagctagccacgctgggctcctcattgcctagctcaggaattcagggctgggaaaatttagccgagtcatcacatttggctactacccgggaaagcagccctcccgagtcaggaacgggctccggttcatcacgtggcagccgcctgcaggagccgcagatttttagttcctaatgcatttgggacaactgtttcaagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgagaacgacagtctgagatactcggcctttgttttgtttgggcaattggctgcctttgccgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgtttttttgttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatgctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccagataactcagtaaacagtggagctggaattcaaacatgtacggtctgacttcttgagcccatactcaataatcatgccatcctgcctttccatggaataactgatggatggttagaaatgttaaaaacaaagcaaatgcaaa

SEQ ID NO: 150513 - DNA, 866 bp, Homo sapiens
  Payload ID: 9729
  Gene Symbol: MRO
  Gene Name: maestro
  Uniprot ID: Q9BYG7
  ENST ID: ENST00000588444
  CDS Start-End: 77-667
atattcacccttcatgaggatgagcacagagcaagaagctagccacgctgggctcctcattgcctagctcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgct

SEQ ID NO: 150514 - DNA, 2129 bp, Homo sapiens
  Payload ID: 9729
  Gene Symbol: MRO
  Gene Name: maestro
  ENST ID: ENST00000585524
  CDS Start-End: 105-437
cccagaattgccatctgcagaatttctgcagaaagtgtcgaccaggctggcatgagggaagaaggaggggaaatcacagcaaggagaaggaaaaacacctcagcatggcgtggggaagcaaaggaattcagggctgggaaaatttagccgagtcatcacatttggctactacccgggaaagcagccctcccgagtcaggaacgggctccggttcatcacgtggcagccgcctgcaggagccgcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgagaacgacagtctgagatactcggcctttgttttgtttgggcaattggctgcctttgccgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgtttttttgttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatgctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccagataactcagtaaacagtggagctggaattcaaacatgtacggtctgacttcttgagcccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttattaattactttttggctattaatgtcaattattttggtgatcaatcctagttatccaaggagtcacatcactcgt

SEQ ID NO: 150515 - DNA, 583 bp, Homo sapiens
  Payload ID: 9729
  Gene Symbol: MRO
  Gene Name: maestro
  ENST ID: ENST00000590988
  CDS Start-End: 122-265
attgccatctgcagaatttctgcagaaagtgtcgaccaggctggcatgagggaagaaggaggggaaatcacagcaaggagaaggaaaaacacctcagcatggcgtggggaagcaaagttccatggaccaaagacagaggagaatcctgggccagcccctttccatccctacttcccagcccaagcagaaaaggacatcaatgatatctttcttttccaagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgcttgcaaaacaacatttcaagcctgttctccatatctgaaactaaaggaggaatacagcttccagagtgaagaagatcaaaggaacactaagctct

SEQ ID NO: 150516 - DNA, 797 bp, Homo sapiens
  Payload ID: 9729
  Gene Symbol: MRO
  Gene Name: maestro
  ENST ID: ENST00000592966
  CDS Start-End: 261-797
ccctcccctgcccaaatactctataaactttgactttcccctcttatttgattctcactttccaacactctgtgccgacccgttatcctggacagaccctgcgtcacctcctaatttcccttcttgtatgttaggaattcagggctgggaaaatttagccgagtcatcacatttggctactacccgggaaagcagccctcccgagtcaggaacgggctccggttcatcacgtggcagccgcctgcaggagccgcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgcttgcaaaacaacatttcaagcctgttctccatatctgaaactaaaggaggaatacagcttccagagtgaagaagatcaaaggaacactaagctctaccagcagctg

SEQ ID NO: 150517 - DNA, 5257 bp, Homo sapiens
  Payload ID: 9729
  Gene Symbol: MRO
  Gene Name: maestro
  Uniprot ID: Q9BYG7
  ENST ID: ENST00000610511
  CDS Start-End: 295-1041
aacgggccttggcagggaggttttgtttggtgcagaggaaaggtccccagaattgccatctgcagaatttctgcagaaagtgtcgaccaggctggcatgagggaagaaggaggggaaatcacagcaaggagaaggaaaaacacctcagcatggcgtggggaagcaaaggaattcagggctgggaaaatttagccgagtcatcacatttggctactacccgggaaagcagccctcccgagtcaggaacgggctccggttcatcacgtggcagccgcctgcaggagccgcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgagaacgacagtctgagatactcggcctttgttttgtttgggcaattggctgcctttgccgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgtttttttgttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatgctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccagataactcagtaaacagtggagctggaattcaaacatgtacggtctgacttcttgagcccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttattaattactttttggctattaatgtcaattattttggtgatcaatcctagttatccaaggagtcacatcactcgtaaaaattacaagaaaaatctctaagtccctctcaccctccctctaaccagattgcatcccaagcttctatagaaactctggtaccacccctgaattcagtatccaggccacacccggagcgttttgttcaagacaatttaaaacacgggggattataaaagctatagctggatcttaagtggcattctgagaatgaggaactcaattttctgctgtagctcccagggacagggtggtgtgacacagatgcggggatgaggagagacctaggcgagatgaggatgtgggagatggcagacagagtggcaagtgccaggcaggaatggattttcttccttcctgttctgaatctgaagaacatgacagcaagagattttaggagggacacaggctcacgagcaaatgggtggttctgagctgtaagccccctgcccctccctagcacccactccccggatgctggcctctttgaaattttgttgcaaggttggtttaaacttgatgcagttccattaagtgatcagtgagtggtctgagaaatggctgcatgtggctggcattcaaaaaggtggggatagggtgagatgggtggggttacgtgctctggagtagaaaaacctatgcagttaatgtccctctgtcggttaaaattgtggaagatgcggttggattatttgactttaagattcaatggtaggcttttattttggtggcccccaatgagtcatgcctcctgatactcatgtctttatttagtcccttctgtttgaatctgggctgcctttgtgacttgctttaatcaggagattgtgataaatggcactgtgccgggcatagaaaccctggcagtttcctcgtttgaattgtgggggaagccagctgccacataaggagttgaactaccaggaacaaatgagagtgcctgagatcaccatgtgaaggagaacggagacacccaacccacagcagagtctgaggcccggacacatgacacaagttgtcccttccagccagacccgagctgttgaagctactccagctgacaccatacggaaaagagacgagcgtctccatcaagcctgtgtcagttgcagaagcatgaacaaagaatcaaatgattgttgttttaagtcattaacctttgggataatttgtcacactgcaataagtaaccagagaagattccttattattaactgttgtcttggctaattttgttttgctcttcataagtcctctttgagtttaaattctatttccagaaatttatgttatcatgaaatttggtggcaagagcaagggactatgtttttttgtttgtttgtttctgtttctcaccatacctaccacagagcctggccatgtgattaaggaacatttgctgaatgactaaatgattccaaattgtagagggaataaagtccaatgtccagtctgccatttcaggctttcaaccttcgttttcttctgttactctctttgcttcagacaagtttgggtcctttctcttctctcaacatgtcttgttctcctataccccctcacctttgctcagtctgctatttctgtgttgagtcccctccctgctcacctgtacacacccacctggaatcacatgcacacacacacacacacatttcacgtgtatctcttatctgtactccaatgcctaggtcaaagtcctgatccccccaatcaggggagagctcaagtctctgaattcccagaacattctagcaatattataccacttatatcttatctgaaaagtttttttttgtatatggctttatgtttttttttttatcctgttagattgaaactacagaaggcagggctgtatcttgtacatcattgtatctccccggtgactgcaaaagtactctgtaaatgaatgttgattagggggaaaaatgtcagaaagtcatctgaagctgtcattccttactgggaggagcccattttgacaaatgagggtcaccaatttcattccttataaccaatgtacaggttacttttatgcttgtgcatttcaagtttccccttccccacgtttatctgaatgccaacccaaaggtaatgttttgacatttcttaattttgaacattaattttgaaccttattgagcagttgaatgaaagaaagaaaaaaggaatgttcaagtgccccgaccctcatgctaagtgcccagggtagagctttgcttggtccctgtgtctctggtgctcatgagataggtctttctttctttatttttatttttgagatggagcctcactctgtcacccaggctggagtgcaatgacacgatctcggctcactgcaacctccacctcctgggttcaagcgattctcctgtctcagcctcctgagtagctgggattacaggtgcctgccaccatggctggctaatttttgtgtttttagtagagacggggtttcaccatgttggccaggctggtctcaaactcctgacctcaagtgatctgctcaccttggtctcccaaagtgctgggattacaggcgtgagccaccgctcctggctgagataggtctttcttaaaggggagagggaagtggtggagagagaggagagaaaatgacaaaggaggaggctgagaatctaacaggtgtgaccaattctgctactgaatgagagcagaagcctgtgaacttccagttaatagaccacttaattgggggaacgcttcacacgttataaaaaagcactagaatgttttgaaagcgagaaacaacagctgtgtagggtagctagcagttagtgttgtacagaagacagatatttgtgcatttctgcattttctaagtttgctgcaatgagcatgtattactttcatagttataaaacacatgcaaaatgcccttttaaaatgaaaaaaaagtccatgagtgtaagtgatatatatgctttggaaagcctgggacggtcattgtttactctcaatagtatgtgtttgcctttgtctttttgagacattttgttttaatctgttgatgacaataacctgttgataatataacttgataacaaataaaatgacttatgattgattatcatttt

SEQ ID NO: 150518 - DNA, 5183 bp, Homo sapiens
  Payload ID: 9730
  Gene Symbol: MROH1
  Gene Name: maestro heat-like repeat family member 1
  Uniprot ID: Q8NDA8
  ENST ID: ENST00000326134
  CDS Start-End: 58-4983
gatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggcgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggttctaggaataaaggtagaaaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcgagtgactgaca

SEQ ID NO: 150519 - DNA, 1712 bp, Homo sapiens
  Payload ID: 9730
  Gene Symbol: MROH1
  Gene Name: maestro heat-like repeat family member 1
  Uniprot ID: Q8NDA8
  ENST ID: ENST00000423230
  CDS Start-End: 98-1366
gggaaggcggcgccccggccgaggtggcggcggctcctcagatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggcgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctggcagcactaacaccagaataacactgatgttgccatcagcagtcacacgactgaaacatgaggactgccctgcacgtgctgctccgcagcctgctgatctaacggccgcgcccgcgtctgttgcttgagtcaccacggctgttacatcccgtgctctcccttctctgccttcttggtgttggttctgcgggcgactgcccatgtggccctcagccccatcctctgttcatggctctctgccactcttgttgtccaaagctctttctctgtaggttccgtgggaagagctcatgggaacatgatcttcgacctcatgcttgctgatcatagtttattgtgccttttatcgttgatggttttgctggttacaggattcttggctgacatttccttgagtgtcttaagttattccatattcttctggcagagagttgccagatttagcaaaaacaaataaacaggatgccccgaata

SEQ ID NO: 150520 - DNA, 5234 bp, Homo sapiens
  Payload ID: 9730
  Gene Symbol: MROH1
  Gene Name: maestro heat-like repeat family member 1
  Uniprot ID: Q8NDA8
  ENST ID: ENST00000528919
  CDS Start-End: 122-5047
ccaggccacctgcattccttgtctcagagcctccctcctgcatcctccaagccagcagttgtgggatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggcgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggttctaggaataaaggtagaaaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccag

SEQ ID NO: 150521 - DNA, 5092 bp, Homo sapiens
  Payload ID: 9730
  Gene Symbol: MROH1
  Gene Name: maestro heat-like repeat family member 1
  ENST ID: ENST00000534366
  CDS Start-End: 125-5023
tgactggtcatagcgtgccgggcatagcgctggcagggccgccgggagccagccctcactcagccaagatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggcgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctc

SEQ ID NO: 150522 - DNA, 3673 bp, Homo sapiens
  Payload ID: 9730
  Gene Symbol: MROH1
  Gene Name: maestro heat-like repeat family member 1
  Uniprot ID: Q8NDA8
  ENST ID: ENST00000544576
  CDS Start-End: 1610-3457
cgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaagattcaggtggtgccgtgcacggctgggtcacacctctgctgtcactgactggctctggcccttcttctgggaggatttcaggagtttctgagccgaggattcccgtcggggagtgtaattgtgtaactgaagtcccgctggttcctctggcctctcaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgaggattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccggtaagcaccaccccctgccccacccccacgccgcccggcagccccgcctgatgcccccacttcacagggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctccc

SEQ ID NO: 150523 - DNA, 5355 bp, Homo sapiens
  Payload ID: 9731
  Gene Symbol: MROH2A
  Gene Name: maestro heat-like repeat family member 2A
  Uniprot ID: A6NES4
  ENST ID: ENST00000389758
  CDS Start-End: 167-5191
attcctataagaaatatgactgaagagcccagctgtctcactttgataaccaattcttccatttgcatttccattgatgtgtattgggccaagagcagagctttttcttgtggttaatatctgtttaatccagaagaagaccctaaggaaagagcttgaggaagagatgactgaagccattacagaagcagcagtagcctcaagtgaggaggtgtcagaggaaagagacgacctggggcctcttgaattacatgacagtggtacctttcaacaagtcgtgaaccttctggacatcattgacagcgagtcagcaaagacggacacaacaggggcaggccttgacatgcggaagaccctggcctcggtgataatcatggagaaggccaccactgagccttctgtagtgataaacactctcatccgctgcctgcaggtgccagagatttccacccagcgcaaggtcaacatttacaacatcctccaggacatcatccagcaggagggggagctggaggagcagtgcgtgcagaggctggtggccattgcctccaaggagatgagggagatcccagagatggagggctatatgaaggcagaggtggccagcgacacactggtggctctgtcccgaaaccacttcagcttggtcatgtacgagctgcagcaccacctcaagcccctcaacctcactgatgaatttgtcatcatcacactggccaagctggccaacggcaatgtgtttgagttcatgccatacatgggcatcaccctggctaccatattcaccatgctgagacttgccaatgaagccaagatacgccaggcgatctgcagtgccatggagaccttctgtgagacggtgcagttttatctgaagcacctggaggagagcgtgtaccccgtgatgactgaggaggagtttgccctgaaggtgttccccatgtatcgctacttcgtgacagtgtggctgaggcactacaaccccgaggtgaagctgggggtgatcaagtccctgaagcccatgctcggcctccttctgcccaacgatgacctgcgggagcaggtctacgactacatccccctgctgctggcggagtaccagggcagtctggaggtgctcttcgtcacgcaggtcttgaggcagatcctggaactgtcagtcaccaccaacacccctgtcccccaaatgcagctacacaccattttcacagaactgcacgtccaggtgtgcaacaaggccccggcccagcatcagtacagcagccagaatctgatggagatggtgcactgcttcgtagcccttgctcgctcctaccccaaggagctgatgaagttcttcttcagccagatggagacaaacaaggaggccgtccgcgtggggactctgaatctgattagggctatagtgagcgcagatgagcccaggatgagtatcagggccatctacctggctatccgggtagtcaagaacaccatctctgatacccggtccaaggtgaggatggctattctccacatcattgggcagttggctctctgtggctaccaggagagaatcaaaggctggggcctgaagtacctgtctgtgcagctgaccttatccacctacaaactgacaaatcgccgggagaagttttatcagagggacttggaggagaggatggtccacaaagtcaccatggacactgtgaagatcattacctcttctgtcagtgggatgaccaccgagttttgggtgaggctgctgtgctacatcatggagacagactacgtggaagctttgactcctatctgtatcagcctcacaaacctggcagaacaccagctccatggccaggatgtggatgtcagcgtggctggcaagagcaggcaagtggacctgcctgcacctcagaagctgctggcccgtctcctggtgctgatgtcatcaccttacaagggggagggtcgtgggatagccatgctcaacctcttgaggaccctgagccagagcatcgcaccctccatggccgacatgtgggagctggagattgcgctactggtccggtacctggaagaacatactgagttcacttgggatcagaaagcctgggaagacaagctgattcagtttctgcgaaactccctcaagaagacccgggggtctagctggagcctgcgcttgagtaaagagctgaacaaccagattgcgagctttgacagcccctctctggagaagggctttctgtaccgggccttgggcttcaccttggccacaggcctggaggccagcaaggtggaggtcctgctgttggagctgctgtacaagacggactacagcaatgactttgacagcgagggtgtgattatgtgctttggcctgtgtgcccggggccaggtaaaaacggtgctgaatgtgcttcatgacttcgaggagaggatccaggagtcagagcagtcctggcagatcagtgcttggcggaaggaccatccctggaggcgggagacagtgaaaagtgccctcatggtgatgtatagctgcgtggcctcctactgccacccccagttgctcctcaacctcgtggacagccccatcaccgctaagatcattcaccattatgtcagcagctgccaggacatctgtctcaaaatggccttcatgaagagtgttgtgcaggttaccaaggccatcaacaacatcaaggacctggaggactttcactttgcccagaagacgactcttaccagcattatagtggcggtcatcaaggcagaaccgactgacaacctggtttctccagtgcgagccttggcgatggaggccctctcgcacctgagcaagctgaagcctttctactccacagaggaaaacagtgagctgatggatatcagcatacattctgtaatttctctccaactcccaggagaggacaatgagtccattaagaccctgtatgcaaatgccctgagctccctggagcagctgatggagagcctcctgcagaggcagctggaccccaaggggctgcaggagatggtgcagctcctggaaaagtggatcttgtcggagaaagaatgggagcgggaaaaggccgtgagcctccatctctatctcatgtggatttatgtccacagcactgctgtctgtatccacctaaagctggggcagtttggcacaatggtcggactcattgccccgtgcacctgtgatgcccatcaaagaacccgcatggcctcaatgaatgtcctgtccagcctgctagatcttcacgcaagccagacctgctccttgtggggcccttccaagcagaaggagcttgagaaatgtaagggggacctccagagcacagatgtggagaagatcttctgtgcatcctccagaatcgccaaggtggtctgcatggagtttagctgcgatgaggtggtctcgctcatccagaagctctgcgagaacactggggccatgaacctgcagcatgacaaggcctctgtcacctggatagccttcttcctccagatgcgggccaaggagctggaggacaaggtggccgagatcctgagtgccatcctggtgcacctgccggtggtggaccacccagaggtgcggcgccttctcattgacggcatcctgctgctggcgcaccaccaccaggagaccatcctcacatcgctcctgaggcagccactgcccatggagagccacctggcagaggtgtggctggcagtgtcggagaacgtgcccttcgcccggaccatgctccacagcctgatgggccggctgcagtcacggctcagccccagaatcagtgccacctccaaggctgacatctggcgcctggctgcggtggaccccctgatgaccctgtgcaccatccaccttctcattcagaagctggatgagaatgacaagctcccggacttcctccctgacctcatctacaccctcctgctgcagcttggaagcagccaccgaccagaggccgccccgccggtcttgaagatgtggaagctggtccacaccactcctctgccggaggagatgaacctgcaaagggtcactatcaagtccatgcagctcttgttcaagagagtcaagagccagcacctggcacataccctggacgagcaggcagtgtgggacctcctgcaggacggcgggacattcctggagggtgtgagcctgctggccaggctgtgcatgcagcacgtggagggccacaggcagaggctggccgagctggtgctcaggggcatggactcagaagtcctgagctgccgcatcagcagcacagcggtctgcttcatgagcggcccagttctgtaccaggagaagctgctgaagccggcagctttgctgctggagaagggtgccgaccaggaggaagacgaggccctgcgggtgctgtccctgcgcgccctcggcaacatggccctgggcgcccccaagaaggtgaagcagtaccggaaggtcttgctggagaagtgcctgggccccctgagggagcccgtgagcaacagcgtgactgccgagggcatggaggccctgaccaagatcctggctgagctccgggaaggggatgtggggtcctctttcgacgccatgtctgagcagtgcaggatcttcttcgacaacgagagcgagctgctgcgtctgaaagccttcatcctctttggaaagctggcaagggtggtcgggatgtccaagaagcatttcttcaaaggggaggtgaagaaggcctggatccccctcatgctgcactcccaggacccctgctccaatgcagcccaagcctgtatggctaccatgtttcagtgtgtgcacttctggggctggaagtccctggagcatccctcagggccaagtgataccgctactgatgacaagatgaccgttttccagacaaccatgtgctccatcctgactcggaaaaagccggctgttctctaccgcttcttgctagaaacaatggcctatgttaaaaataacttgtcaagaatcagaatcgctgcttgcaacttggcaggaattattatgaagcagatgtctacacattatctgaaaaagctggacttcccagcattacggaattccctccaggaactacagctggacccggatcccggggtcaggagggcagccctggagacgctcacagtcttggatagctgtagtcagcatgggtttctggcttcaccccaaggaatgtcctaggtggtccaaacataagacgtaaactgtcttcttagtgccaaatgcaagccctttttaatttagtttgtaagaagtttagtttgtaggaaaaacactattgtaaaataactagtatccttttgtttccttccgttgaaataaacctccactgtcgttggagtaga

SEQ ID NO: 150524 - DNA, 254 bp, Homo sapiens
  Payload ID: 9731
  Gene Symbol: MROH2A
  Gene Name: maestro heat-like repeat family member 2A
  ENST ID: ENST00000430892
  CDS Start-End: 49-254
cgggcagaatccaccctgtagagactgcctctggagcttgaggaagagatgactgaagccattacagaagcagcagtagcctcaagtgaggaggtgtcagaggaaagagacgacctggggcctcttgaattacatgacagtggtacctttcaacaagtcgtgaaccttctggacatcattgacagcgagtcagcaaagacggacacaacaggggcaggccttgacatgcggaagaccctggcctcggtgataat

SEQ ID NO: 150525 - DNA, 252 bp, Homo sapiens
  Payload ID: 9731
  Gene Symbol: MROH2A
  Gene Name: maestro heat-like repeat family member 2A
  ENST ID: ENST00000428446
  CDS Start-End: 47-252
cgggcagaatccaccctgtagagactgcctctggcttgaggaagagatgactgaagccattacagaagcagcagtagcctcaagtgaggaggtgtcagaggaaagagacgacctggggcctcttgaattacatgacagtggtacctttcaacaagtcgtgaaccttctggacatcattgacagcgagtcagcaaagacggacacaacaggggcaggccttgacatgcggaagaccctggcctcggtgataat

SEQ ID NO: 150526 - DNA, 146 bp, Homo sapiens
  Payload ID: 9731
  Gene Symbol: MROH2A
  Gene Name: maestro heat-like repeat family member 2A
  ENST ID: ENST00000454283
  CDS Start-End: 118-146
cgggcagaatccaccctgtagagactgcctctgggtacctttcaacaagtcgtgaaccttctggacatcattgacagcgagtcagcaaagacggacacaacaggggcaggccttgacatgcggaagaccctggcctcggtgataat

SEQ ID NO: 150527 - DNA, 5324 bp, Homo sapiens
  Payload ID: 9731
  Gene Symbol: MROH2A
  Gene Name: maestro heat-like repeat family member 2A
  ENST ID: ENST00000610772
  CDS Start-End: 94-5160
cattgctgtggctgcttgggccacgggagagggaaccttgtgagccgggcagaatccaccctgtagagactgcctctggagcttgaggaagagatgactgaagccattacagaagcagcagtagcctcaagtgaggaggtgtcagaggaaagagacgacctggggcctcttgaattacatgacagtggtacctttcaacaagtcgtgaaccttctggacatcattgacagcgagtcagcaaagacggacacaacaggggcaggccttgacatgcggaagaccctggcctcggtgataatcatggagaaggccaccactgagccttctgtagtgataaacactctcatccgctgcctgcaggtgccagagatttccacccagcgcaaggtcaacatttacaacatcctccaggacatcatccagcaggagggggagctggaggagcagtgcgtgcagaggctggtggccattgcctccaaggagatgagggagatcccagagatggagggctatatgaaggcagaggtggccagcgacacactggtggctctgtcccgaaaccacttcagcttggtcatgtacgagctgcagcaccacctcaagcccctcaacctcactgatgaatttgtcatcatcacactggccaagctggccaacggcaatgtgtttgagttcatgccatacatgggcatcaccctggctaccatattcaccatgctgagacttgccaatgaagccaagatacgccaggcgatctgcagtgccatggagaccttctgtgagacggtgcagttttatctgaagcacctggaggagagcgtgtaccccgtgatgactgaggaggagtttgccctgaaggtgttccccatgtatcgctacttcgtgacagtgtggctgaggcactacaaccccgaggtgaagctgggggtgatcaagtccctgaagcccatgctcggcctccttctgcccaacgatgacctgcgggagcaggtctacgactacatccccctgctgctggcggagtaccagggcaaaggtcacctgccaccatttgccaatccactgcaggtcttgaggcagatcctggaactgtcagtcaccaccaacacccctgtcccccaaatgcagctacacaccattttcacagaactgcacgtccaggtgtgcaacaaggccccggcccagcatcagtacagcagccagaatctgatggagatggtgcactgcttcgtagcccttgctcgctcctaccccaaggagctgatgaagttcttcttcagccagatggagacaaacaaggaggccgtccgcgtggggactctgaatctgattagggctatagtgagcgcagatgagcccaggatgagtatcagggccatctacctggctatccgggtagtcaagaacaccatctctgatacccggtccaaggtgaggatggctattctccacatcattgggcagttggctctctgtggctaccaggagagaatcaaaggctggggcctgaagtacctgtctgtgcagctgaccttatccacctacaaactgacaaatcgccgggagaagttttatcagagggacttggaggagaggatggtccacaaagtcaccatggacactgtgaagatcattacctcttctgtcagtgggatgaccaccgagttttgggtgaggctgctgtgctacatcatggagacagactacgtggaagctttgactcctatctgtatcagcctcacaaacctggcagaacaccagctccatggccaggatgtggatgtcagcgtggctggcaagagcaggcaagtggacctgcctgcacctcagaagctgctggcccgtctcctggtgctgatgtcatcaccttacaagggggagggtcgtgggatagccatgctcaacctcttgaggaccctgagccagagcatcgcaccctccatggccgacatgtgggagctggagattgcgctactggtccggtacctggaagaacatactgagttcacttgggatcagaaagcctgggaagacaagctgattcagtttctgcgaaactccctcaagaagacccgggggtctagctggagcctgcgcttgagtaaagagctgaacaaccagattgcgagctttgacagcccctctctggagaagggctttctgtaccgggccttgggcttcaccttggccacaggcctggaggccagcaaggtggaggtcctgctgttggagctgctgtacaagacggactacagcaatgactttgacagcgagggtgtgattatgtgctttggcctgtgtgcccggggccaggtaaaaacggtgctgaatgtgcttcatgacttcgaggagaggatccaggagtcagagcagtcctggcagatcagtgcttggcggaaggaccatccctggaggcgggagacagtgaaaagtgccctcatggtgatgtatagctgcgtggcctcctactgccacccccagttgctcctcaacctcgtggacagccccatcaccgctaagatcattcaccattatgtcagcagctgccaggacatctgtctcaaaatggccttcatgaagagtgttgtgcaggttaccaaggccatcaacaacatcaaggacctggaggactttcactttgcccagaagacgactcttaccagcattatagtggcggtcatcaaggcagaaccgactgacaacctggtttctccagtgcgagccttggcgatggaggccctctcgcacctgagcaagctgaagcctttctactccacagaggaaaacagtgagctgatggatatcagcatacattctgtaatttctctccaactcccaggagaggacaatgagtccattaagaccctgtatgcaaatgccctgagctccctggagcagctgatggagagcctcctgcagaggcagctggaccccaaggggctgcaggagatggtgcagctcctggaaaagtggatcttgtcggagaaagaatgggagcgggaaaaggccgtgagcctccatctctatctcatgtggatttatgtccacagcactgctgtctgtatccacctaaagctggggcagtttggcacaatggtcggactcattgccccgtgcacctgtgatgcccatcaaagaacccgcatggcctcaatgaatgtcctgtccagcctgctagatcttcacgcaagccagacctgctccttgtggggcccttccaagcagaaggagcttgagaaatgtaagggggacctccagagcacagatgtggagaagatcttctgtgcatcctccagaatcgccaaggtggtctgcatggagtttagctgcgatgaggtggtctcgctcatccagaagctctgcgagaacactggggccatgaacctgcagcatgacaaggcctctgtcacctggatagccttcttcctccagatgcgggccaaggagctggaggacaaggtggccgagatcctgagtgccatcctggtgcacctgccggtggtggaccacccagaggtgcggcgccttctcattgacggcatcctgctgctggcgcaccaccaccaggagaccatcctcacatcgctcctgaggcagccactgcccatggagagccacctggcagaggtgtggctggcagtgtcggagaacgtgcccttcgcccggaccatgctccacagcctgatgggccggctgcagtcacggctcagccccagaatcagtgccacctccaaggctgacatctggcgcctggctgcggtggaccccctgatgaccctgtgcaccatccaccttctcattcagaagctggatgagaatgacaagctcccggacttcctccctgacctcatctacaccctcctgctgcagcttggaagcagccaccgaccagaggccgccccgccggtcttgaagatgtggaagctggtccacaccactcctctgccggaggagatgaacctgcaaaggtgctctcgagggcgggtcactatcaagtccatgcagctcttgttcaagagagtcaagagccagcacctggcacataccctggacgagcaggcagtgtgggacctcctgcaggacggcgggacattcctggagggtgtgagcctgctggccaggctgtgcatgcagcacgtggagggccacaggcagaggctggccgagctggtgctcaggggcatggactcagaagtcctgagctgccgcatcagcagcacagcggtctgcgtggaaatgaggcaccggttcatgagcggcccagttctgtaccaggagaagctgctgaagccggcagctttgctgctggagaagggtgccgaccaggaggaagacgaggccctgcgggtgctgtccctgcgcgccctcggcaacatggccctgggcgcccccaagaaggtgaagcagtaccggaaggtcttgctggagaagtgcctgggccccctgagggagcccgtgagcaacagcgtgactgccgagggcatggaggccctgaccaagatcctggctgagctccgggaaggggatgtggggtcctctttcgacgccatgtctgagcagtgcaggatcttcttcgacaacgagagcgagctgctgcgtctgaaagccttcatcctctttggaaagctggcaagggtggtcgggatgtccaagaagcatttcttcaaaggggaggtgaagaaggcctggatccccctcatgctgcactcccaggacccctgctccaatgcagcccaagcctgtatggctaccatgtttcagtgtgtgcacttctggggctggaagtccctggagcatccctcagggccaagtgataccgctactgatgacaagatgaccgttttccagacaaccatgtgctccatcctgactcggaaaaagccggctgttctctaccgcttcttgctagaaacaatggcctatgttaaaaataacttgtcaagaatcagaatcgctgcttgcaacttggcaggaattattatgaagcagatgtctacacattatctgaaaaagctggacttcccagcattacggaattccctccaggaactacagctggacccggatcccggggtcaggagggcagccctggagacgctcacagtcttggatagctgtagtcagcatgggtttctggcttcaccccaaggaatgtcctaggtggtccaaacataagacgtaaactgtcttcttagtgccaaatgcaagccctttttaatttagtttgtaagaagtttagtttgtaggaaaaacactattgtaaaataactagtatccttttgtttccttccgttgaaataaacctccactgtcgttggagtaga

SEQ ID NO: 150528 - DNA, 5239 bp, Homo sapiens
  Payload ID: 9732
  Gene Symbol: MROH2B
  Gene Name: maestro heat-like repeat family member 2B
  Uniprot ID: Q7Z745
  ENST ID: ENST00000399564
  CDS Start-End: 452-5209
gagttcaccataaagcctttcccaacatcaggacagtaaagcaactactgaaaaccattcctgaatttgtgatcaatggactcaagtttagggagaggagcacctttggtctgcaacaatggtttgaatcccagtctctaattacttctttcccaaatactctggtcaccaaagggacaatatttggtgagatgcagccattttgttggttagcaggagttcagacgcaagacaatgtcatagtggtagaatacagtatcaacttcaacagcaagcccatctctggaagctcccagaccattgtgccaatcaagtggaggaggcactttcatttagagaggcttatgtgaaccttatatgagaaacttgccaacctgcctctttgattttttagccttactatttctaatacttaggtgctatcttttagagaccctgaaacagccaagacatgacacttagtacagaggaatccatagagatgtttggggatattaacctcactcttggcatgctgaacaaggaagatattgttaacaaggaagacatttacagtcatctcacttctgttattcagaatactgacatcttggatgatgcaattgtccaacgattgatttattatgcttctaaggatatgagagacaacaatatgctcagagaaatcagaatgctagctggtgaggttttggtgtctcttgctgcacatgatttcaactctgtgatgtatgaagtacaaagtaacttcaggatcttagagctaccagatgaattcgttgtgcttgccctggctgaattggcaaccagctatgtgtcccagagtattcctttcatgatgatgaccctgctcaccatgcaaaccatgctcaggctggccgaggatgaaaggatgaaggggactttctgtattgcccttgagaaattcagcaaagccatttacaaatatgtcaaccactggagagattttccctaccccagactggatgccaaccgactgtctgacaagatcttcatgctgttctggtatataatggagaagtgggcccctttggcctcacccatgcagactttgagcatcgttaaggcccacgggcccacggtgagcttgctgctgcatcgggaagacttccgtggatacgccctgggccaggtgccctggctcctgaaccagtataaagacaaagagattgatttccatgtcactcagagcctaaaacaaatactgactgcagcagttctttatgacattggccttccaaggagcttgagaagatccatctttatcaatttactccagcagatctgcagagctccagagcctccagtaaaggaaaatgaaatgaaagcttcaagctgttttctcattctagcccattccaatcctggagagctgatggaattttttgatgaacaagtaagaagtaataatgaagccattcgagtgggaatcttgactttgttaagattggctgtcaatgctgatgagcccaggttgagggatcacatcatttcaatagaaagaacagtcaaaatcgtcatgggtgatctcagtacaaaagtaagaaattctgttcttctcctcatccaaaccatgtgtgaaaagtcctatattgaagctcgggaaggatggccattgattgattatgtcttctcccagtttgcaacgttgaacaggaatctggagaaaccagtgaaaactaactttcatgagaatgaaaaggaagaggaatctgtccgagaaacaagccttgaggtcttaaaaaccctggacccactggtcattggaatgcctcaggtgctatggccaaggatcctgacttttgtggtacctgcagaatacacagaagctctggagcccctgtttagtatcatcagaattctgattatggcagaggagaagaagcagcacagtgccaaggagtcgacagcacttgtcgtctctacaggagctgtgaaacttccttcaccacagcagctactggccagacttctggtaatatctatgcctgccagtttaggggagttacgtggggctggtgcaatagggcttttgaagatactgcctgagataattcacccaaaattggtagacctatggaaaacacgtttacctgagcttctgcagcctctggaaggaaagaacatcagtaccgttctatgggaaaccatgctgcttcagttgctcaaagaatccttatggaagatcagtgatgtggcctggaccattcagctgactcaggatttcaaacagcaaatgggcagttacagcaataactccactgagaagaaattcctttggaaagccttgggaaccaccttagcatgctgccaagattcagactttgtaaactcacagattaaggagtttctgactgctcccaaccaactgggggatcaaagacagggaataacatctattttaggatactgtgccgagaaccatttggatattgttttaaaagttcttaaaacattccaaaatcaggaaaagtttttcatgaatcgatgtaagagccttttttctgggaaaaagagcctgaccaagacagatgtcatggtcatctatggagcagtggccctccatgctcccaagaagcaacttctctccagacttaatcaagatatcatatcccaagtcctgtctcttcatggccagtgctctcaggttctgggcatgtctgtgatgaacaaggacatggatctgcaaatgagtttcacaagaagcatcactgagattggcattgctgtccaagatgctgaggatcaggggttccagttttcctacaaggagatgctgattggttacatgctggacttcattagagacgagcccctggattccttagctagccctattcggtggaaagccttaatcgccattaggtatctcagtaaactgaaacctcagctctcactacaagaccaccttaacattcttgaggagaatattcggaggctgctgccccttccacctctggaaaatctgaaaagtgaaggccagacagacaaggacaaggagcacattcaatttctctatgaacgatccatggacgccctaggaaaacttctgaagaccatgatgtgggataatgtgaatgcagaggactgtcaagaaatgtttaatcttctccaaatgtggcttgtttcacaaaaagagtgggaaagagaaagagccttccagatcactgcgaaagtgctgacaaatgatattgaggcaccagagaactttaaaattggttcactgcttggacttctggctcctcactcctgtgataccctgcccaccatccgtcaggcggctgctagctcaactattggtctgttctatataaaaggcattcacttggaagtggaaagactgcagggtttgcaggaagggctggaaagtgatgacgtgcaggttcagatcaagatttcttctaaaatagctaagattgtcagtaagttcatcccaaatgaagaaattctgatgttcctagaggaaatgctggacggtctggagagcctcaaccccacttgtacaaaggcctgtggcatatggatgatcactgtcctgaagcagcagggagctgctctggaagatcagctattggagatcttaggcacaatctaccatcacatgccagtcctcagacaaaaagaagaaagttttcagttcattctagaagccatctcccagatagccagctttcacatggatacagttgttgtcaaccttttacagaagcctctgccttttgacagggacacaaagacattgtggaaggcgctggctgaaaagccagcctccagtgggaaactcttgcaagccttaatagacaaactggagactgagttagaagatgacatcgccagggttgaggcaatttcagtggcctgtgctatgtatgaagtgatctcaatgggcacctctgtcaccggcttgtatccagagctgttcactctcctcctgaagctggttagctgcacactgggccagaagatgctcacttgtccctggagccataggcggcatgtgatgcagcagggagaacagcagcagatcccagacccctgcaggctttcaactgctactttaaaatgtttgcaagcccaagccatgagagaaggccttgcaaaggaatctgatgagggggacaacttatggactctactcagcagtcctagtacccaccacataggcgtatgttcactggccaggagcatggcagtgtggcaacacggagtcatactggacatcatggaacagctgctctcatctcttacctcctcctcggagaactaccggataaccggcgcagctttcttctctgagctcatgaaggaaccaatcctttggaagcatgggaatctgcgaaatgtgctgatcttgatggatcaaagtgcctgggactccaacgccactctgaggcagatggccatccgagggctcggcaacacagcatccggggctcctcacaaggtgaagaaacataagcagttaatgctagaatctatcatcagaggcctgtatcacctagctcgcactgaagtcgtctgtgaaagcttgaaggctctaaaaaaaatcctggagctgctgacagaccgagacgtgagcttctacttcaaggaaatagtgctgcaaacaaggaccttctttgaagatgagcaggatgatgtgagattgactgccatcttcttatttgaggacctggcacccctaacaggaagaaggtggaagattttttttgctgaagaaataaaaaagagcctgatttcattccttctgcacctttgggatcccaaccccaagattggagttgcttgccgtgatgtcttgatggtctgcattccctttttgggcctccaggagctctatggggtattagaccgtctccttgatcaggatctaccaagggccagggatttctacaggcaattctgtgtgaaactggccaagaaaaaccaggaaattctgtggatcctccacacacactccttcaccttcttcaccagcacctgggaggtgatcaggagtgcagctgtcaaactcacagatgccgttgttctcaatttgaccagccaatatgtggagttactagacagagaacaactgaccacacgactccaagcacttcgtcaagatccgtgtattagtgtccagagagcagctgaggctgctttgcaaaccctcctgagaaggtgtaaagagacaagcattcctctgtaagccatcaagaaataaactgctggcttttcc

SEQ ID NO: 150529 - DNA, 3745 bp, Homo sapiens
  Payload ID: 9732
  Gene Symbol: MROH2B
  Gene Name: maestro heat-like repeat family member 2B
  ENST ID: ENST00000506092
  CDS Start-End: 292-3714
atttgtttgctgcctgtacagactttgagcatcgttaaggcccacgggcccacggtgagcttgctgctgcatcgggaagacttccgtggatacgccctgggccaggtgccctggctcctgaaccagtataaagacaaagagattgatttccatgtcactcagtttgcaacgttgaacaggaatctggagaaaccagtgaaaactaactttcatgagaatgaaaaggaagaggaatctgtccgagaaacaagccttgaggtcttaaaaaccctggacccactggtcattggaatgcctcaggtgctatggccaaggatcctgacttttgtggtacctgcagaatacacagaagctctggagcccctgtttagtatcatcagaattctgattatggcagaggagaagaagcagcacagtgccaaggagtcgacagcacttgtcgtctctacaggagctgtgaaacttccttcaccacagcagctactggccagacttctggtaatatctatgcctgccagtttaggggagttacgtggggctggtgcaatagggcttttgaagatactgcctgagataattcacccaaaattggtagacctatggaaaacacgtttacctgagcttctgcagcctctggaaggaaagaacatcagtaccgttctatgggaaaccatgctgcttcagttgctcaaagaatccttatggaagatcagtgatgtggcctggaccattcagctgactcaggatttcaaacagcaaatgggcagttacagcaataactccactgagaagaaattcctttggaaagccttgggaaccaccttagcatgctgccaagattcagactttgtaaactcacagattaaggagtttctgactgctcccaaccaactgggggatcaaagacagggaataacatctattttaggatactgtgccgagaaccatttggatattgttttaaaagttcttaaaacattccaaaatcaggaaaagtttttcatgaatcgatgtaagagccttttttctgggaaaaagagcctgaccaagacagatgtcatggtcatctatggagcagtggccctccatgctcccaagaagcaacttctctccagacttaatcaagatatcatatcccaagtcctgtctcttcatggccagtgctctcaggttctgggcatgtctgtgatgaacaaggacatggatctgcaaatgagtttcacaagaagcatcactgagattggcattgctgtccaagatgctgaggatcaggggttccagttttcctacaaggagatgctgattggttacatgctggacttcattagagacgagcccctggattccttagctagccctattcggtggaaagccttaatcgccattaggtatctcagtaaactgaaacctcagctctcactacaagaccaccttaacattcttgaggagaatattcggaggctgctgccccttccacctctggaaaatctgaaaagtgaaggccagacagacaaggacaaggagcacattcaatttctctatgaacgatccatggacgccctaggaaaacttctgaagaccatgatgtgggataatgtgaatgcagaggactgtcaagaaatgtttaatcttctccaaatgtggcttgtttcacaaaaagagtgggaaagagaaagagccttccagatcactgcgaaagtgctgacaaatgatattgaggcaccagagaactttaaaattggttcactgcttggacttctggctcctcactcctgtgataccctgcccaccatccgtcaggcggctgctagctcaactattggtctgttctatataaaaggcattcacttggaagtggaaagactgcagggtttgcaggaagggctggaaagtgatgacgtgcaggttcagatcaagatttcttctaaaatagctaagattgtcagtaagttcatcccaaatgaagaaattctgatgttcctagaggaaatgctggacggtctggagagcctcaaccccacttgtacaaaggcctgtggcatatggatgatcactgtcctgaagcagcagggagctgctctggaagatcagctattggagatcttaggcacaatctaccatcacatgccagtcctcagacaaaaagaagaaagttttcagttcattctagaagccatctcccagatagccagctttcacatggatacagttgttgtcaaccttttacagaagcctctgccttttgacagggacacaaagacattgtggaaggcgctggctgaaaagccagcctccagtgggaaactcttgcaagccttaatagacaaactggagactgagttagaagatgacatcgccagggttgaggcaatttcagtggcctgtgctatgtatgaagtgatctcaatgggcacctctgtcaccggcttgtatccagagctgttcactctcctcctgaagctggttagctgcacactgggccagaagatgctcacttgtccctggagccataggcggcatgtgatgcagcagggagaacagcagcagatcccagacccctgcaggctttcaactgctactttaaaatgtttgcaagcccaagccatgagagaaggccttgcaaaggaatctgatgagggggacaacttatggactctactcagcagtcctagtacccaccacataggcgtatgttcactggccaggagcatggcagtgtggcaacacggagtcatactggacatcatggaacagctgctctcatctcttacctcctcctcggagaactaccggataaccggcgcagctttcttctctgagctcatgaaggaaccaatcctttggaagcatgggaatctgcgaaatgtgctgatcttgatggatcaaagtgcctgggactccaacgccactctgaggcagatggccatccgagggctcggcaacacagcatccggggctcctcacaaggtgaagaaacataagcagttaatgctagaatctatcatcagaggcctgtatcacctagctcgcactgaagtcgtctgtgaaagcttgaaggctctaaaaaaaatcctggagctgctgacagaccgagacgtgagcttctacttcaaggaaatagtgctgcaaacaaggaccttctttgaagatgagcaggatgatgtgagattgactgccatcttcttatttgaggacctggcacccctaacaggaagaaggtggaagattttttttgctgaagaaataaaaaagagcctgatttcattccttctgcacctttgggatcccaaccccaagattggagttgcttgccgtgatgtcttgatggtctgcattccctttttgggcctccaggagctctatggggtattagaccgtctccttgatcaggatctaccaagggccagggatttctacaggcaattctgtgtgaaactggccaagaaaaaccaggaaattctgtggatcctccacacacactccttcaccttcttcaccagcacctgggaggtgatcaggagtgcagctgtcaaactcacagatgccgttgttctcaatttgaccagccaatatgtggagttactagacagagaacaactgaccacacgactccaagcacttcgtcaagatccgtgtattagtgtccagagagcagctgaggctgctttgcaaaccctcctgagaaggtgtaaagagacaagcattcctctgtaagccatcaagaaataaactgctggcttttcct

SEQ ID NO: 150530 - DNA, 3818 bp, Homo sapiens
  Payload ID: 9733
  Gene Symbol: MROH5
  Gene Name: maestro heat-like repeat family member 5
  ENST ID: ENST00000523857
  CDS Start-End: 82-201
agtgccgtagacagggccggcccacaggcgtgaggccagagttagtggtgagctcctgtgggtctgcactgcaccccaaccatggacaggcagtgttctgaaaggccatacagctgcaccccgacgggtagagtgtcgtcagccgtgtcccaaaactccagccaccggcttcaagatgctgcaggacatgaacagtgctgaccccttccacttgaagtacatcatcaagaagatcaagaacatggctcatggctcccccaagctggtgatggaaaccatccacgactacttcatagacaacccagagatctccagcaggcacaagttccggctgttccagaccctggagatggtcatcggggccagtgacgtcctggaggagacctgggagaaaactttcacacggctcgctctggagaacatgaccaaggccacggagctggaagacatataccaggacgcggccagcaacatgctggtggccatctgcaggcactcgtggcgggtggtggcgcagcatctggagacggagctcctgacgggcgtcttcccacacagaagcctcctctacgtgatgggcgtcctgtcctccagcgtattgcaacagctggacctggacggagccaggatgacagaggaggtcccaggaggtggcccaggacaggtgtgaggctggcacatggccgggcaactccactgccagctgctgcatctgtctcctcccttggtcacacaagaggagctcttcagccaggaagacaaggcctgctgggaagagcaactgatccagatggccatcaagtcagtcccgttcctgagcacggatgtgtggtccaaggagctgctgtggacactcaccacgcccagctggacccaacaggagcagtcccctgagaaggccttcctgtttacctactatgggctaatccttcaagctgaaaaaaatggtgccacggtcaggagacacctgcaagccctcctggaaacatcccaccagtggcccaagcagagggagggcatggctctgaccttggggctggcggccacacgccacctggatgacgtctgggccgtcctggaccagtttggcaggagcaggcccatcagatggagtctccccagctcctccccaaaggtactggctcaggggtcctcagagaccagcaggggtctaggacagcaagacccccaccatctgtgaagaactcggaggacctgcgctggaaatgggccagcagcaccatcctcctggcatacggccaggtggcagccaaagcccgggcccacatcctcccgtgggtggacaacatcgtgtccaggatggtcttctacttccactacagctcttgggacgagaccctgaagcagagcttcctcacagccaccctgatgctgatgggtgcggtgagccggagtgagggcgcccacagctacgagttcttccagacctctgagctcctccagtgtctgatggttttgatggagaaggagccccaggacactctgtgcacgcggagtcgccagcaggccatgcacatcgcgtccagcctctgagcctgtacagcaggaccatggaggcgctggacttcatgctgcaaagcctcatcatgcagaaccccaccgccgacgagctgcatttcctgctgtcggtgaggctgcagggaggccagtcggctggggccgaggggtcctcagcctatggccagactccaaaggagggcatctcagaggagacaaggcgggacctgggggcttcgagtggtccaggaaccaggagggcacctgtacatctggctggcgtcggagaaggcgcatgagcggcagcgggctgtgcacagctgcatgatcctcctcaaattcctgaaccacaatggctacttggacccaaaagaggacttcaaaaggattgggcaattggtgggcatactggggatgctgtgccaggacccagacagggccacccagcgctgcagcctggaaggggcaagccatctctaccagctcttgatgtgccacaaaagagaagctttgcaggcagaatcacaggcccccaaggagctctcccaggcccattcggacggagccccactctggaacagcagagaccagaaggccactcccctgggcccccaggagatggcaaagaaccacatcttccagctctgcagcttccaagtcatcaaggatatcatgcagcagctcacactggcagagttgagcgacctcatctggacggccatcgacggcctgggctccaccagccccttccgcgtgcaggcagcctccgagatgctgctcacagccgtccaggagcacggggccaagctggagatcgtttccagcatggcccaggccatccgcctccgcctgtgctctgtccacatcccgcaagccaaggaaaagaccctgcacgccatcaccctgctggcccggagccacacctgtgagctggtggccaccttcctgaacatctccatccccttggacagccacaccttccagctgtggagggccctgggggctgggcagcccacgagccacctggtgctgaccacactgctggcctgtctgcaggagcgacccctgcccaccggtgccagcgacagcagcccctgccccaaggagaagacctacctgcgtttgctggctgccatgaacatgctgcacgagctgcagtttgcccgggagttcaagcaggccgtgcaggagggctaccccaagctcttcctggccctcctcacccagatgcactatgtcttggagctgaacctgcccagcgagccctagcccaagcagcaggcccaggaggcggccgtgcccagcccccaaagctgcagcacgtcactggaggcactgaagagcctgctgtccaccacggggcactggcatgactttgcccacctggagctgcagggatcctgggagctcttcaccaccatccacacctacccgaagggcgtgggcctccttgccagggccatggtgcagaaccactgcaggcagatcccagcggtgctgcgtcagctgctgcccagcctgcagagcccacaggagcgtgagaggaaggtggccatcctcatcctcaccaagttcctctacagccctgtcctgctggaggtgcttcccaaacaagctgccttgaccgtgctggcacaaggcctccacgaccccagccctgaggtccgcgtgttgagtctgcagggcctaagcaacatcctcttccacccagataaggagcgggacgggattcgggcggcagccatggcactgttcggggacctggtggcggccatggcagacagggagctgagcggcctgcggacccaggtgcaccagagcatggtgcccctgctcctacacctgaaggaccaatgcccagctgtcgccacgcaggccaagttcaccttctaccgctgtgctgtgctgctccgctggcggctactgcacaccctcttctgcacgctggcctgggagaggggcctcagcgcccgccacttcctctggacctgcctggccacaccatctgctaccacccccaggccgtgttccagatgctgaatgctgtggacaccaacctgctgttccgcacttttgaacatctcagaagtgaccctgagcccagcatccgggaattcgccaccagccagctctccttcctccagaaggtgtcggccagacccaagcagtgacctccagccatcctcccccacccaccgccttcccctcccgtgtccacctggtcagccctgccccatccgccccccacagagcttggttgcataacgtttttccatttgaaagaaagatctagattcaac

SEQ ID NO: 150531 - DNA, 3830 bp, Homo sapiens
  Payload ID: 9733
  Gene Symbol: MROH5
  Gene Name: maestro heat-like repeat family member 5
  ENST ID: ENST00000521053
  CDS Start-End: 82-201
agtgccgtagacagggccggcccacaggcgtgaggccagagttagtggtgagctcctgtgggtctgcactgcaccccaaccatggacaggcagtgttctgaaaggccatacagctgcaccccgacgggtagagtgtcgtcagccgtgtcccaaaactccagccaccggcttcaagatgctgcaggacatgaacagtgctgaccccttccacttgaagtacatcatcaagaagatcaagaacatggctcatggctcccccaagctggtgatggaaaccatccacgactacttcatagacaacccagagatctccagcaggcacaagttccggctgttccagaccctggagatggtcatcggggccagtgacgtcctggaggagacctgggagaaaactttcacacggctcgctctggagaacatgaccaaggccacggagctggaagacatataccaggacgcggccagcaacatgctggtggccatctgcaggcactcgtggcgggtggtggcgcagcatctggagacggagctcctgacgggcgtcttcccacacagaagcctcctctacgtgatgggcgtcctgtcctccagcgaggagctcttcagccaggaagacaaggcctgctgggaagagcaactgatccagatggccatcaagtcagtcccgttcctgagcacggatgtgtggtccaaggagctgctgtggacactcaccacgcccagctggacccaacaggagcagtcccctgagaaggccttcctgtttacctactatgggctaatccttcaagctgaaaaaaatggtgccacggtcaggagacacctgcaagccctcctggaaacatcccaccagtggcccaagcagagggagggcatggctctgaccttggggctggcggccacacgccacctggatgacgtctgggccgtcctggaccagtttggcaggagcaggcccatcagatggagtctccccagctcctccccaaaggtactggctcaggggtcctcagagaccagcaggggtctaggacagcaagacccccaccatctgtgaagaactcggaggacctgcgctggaaatgggccagcagcaccatcctcctggcatacggccaggtggcagccaaagcccgggcccacatcctcccgtgggtggacaacatcgtgtccaggatggtcttctacttccactacagctcttgggacgagaccctgaagcagagcttcctcacagccaccctgatgctgatgggtgcggtgagccggagtgagggcgcccacagctacgagttcttccagacctctgagctcctccagtgtctgatggttttgatggagaaggagccccaggacactctgtgcacgcggagtcgccagcaggccatgcacatcgcgtccagcctctgagcctgtacagcaggaccatggaggcgctggacttcatgctgcaaagcctcatcatgcagaaccccaccgccgacgagctgcatttcctgctgtcgcacctgtacatctggctggcgtcggagaaggcgcatgagcggcagcgggctgtgcacagctgcatgatcctcctcaaattcctgaaccacaatggctacttggacccaaaagaggacttcaaaaggattgggcaattggtgggcatactggggatgctgtgccaggacccagacagggccacccagcgctgcagcctggaaggggcaagccatctctaccagctcttgatgtgccacaaaacaggagaagctttgcaggcagaatcacaggcccccaaggagctctcccaggcccattcggacggagccccactctggaacagcagagaccagaaggccactcccctgggcccccaggagatggcaaagaaccacatcttccagctctgcagcttccaagtcatcaaggatatcatgcagcagctcacactggcagagttgagcgacctcatctggacggccatcgacggcctgggctccaccagccccttccgcgtgcaggcagcctccgagatgctgctcacagccgtccaggagcacggggccaagctggagatcgtttccagcatggcccaggccatccgcctccgcctgtgctctgtccacatcccgcaagccaaggaaaagaccctgcacgccatcaccctgctggcccggagccacacctgtgagctggtggccaccttcctgaacatctccatccccttggacagccacaccttccagctgtggagggccctgggggctgggcagcccacgagccacctggtgctgaccacactgctggcctgtctgcaggagcgacccctgcccaccggtgccagcgacagcagcccctgccccaaggagaagacctacctgcgtttgctggctgccatgaacatgctgcacgagctgcagtttgcccgggagttcaagcaggccgtgcaggagggctaccccaagctcttcctggccctcctcacccagatgcactatgtcttggagctgaacctgcccagcgagccctagcccaagcagcaggcccaggaggcggccgtgcccagcccccaaagctgcagcacgtcactggaggcactgaagagcctgctgtccaccacggggcactggcatgactttgcccacctggagctgcagggatcctgggagctcttcaccaccatccacacctacccgaagggcgtgggcctccttgccagggccatggtgcagaaccactgcaggcagatcccagcggtgctgcgtcagctgctgcccagcctgcagagcccacaggagcgtgagaggaaggtggccatcctcatcctcaccaagttcctctacagccctgtcctgctggaggtgcttcccaaacaagctgccttgaccgtgctggcacaaggcctccacgaccccagccctgaggtccgcgtgttgagtctgcagggcctaagcaacatcctcttccacccagataagggaagcctgctccagggacagctgcggcccttgctcgacggcttcttccagagcagcgaccaggtgatcgtgtgcatcatgggcaccgtgtcagacacgctgcaccgcctgggcgcgcagggcacagggagtcagagcctcggcgttgccatcagcacacgctccttctttaatgacgagcgggacgggattcgggcggcagccatggcactgttcggggacctggtggcggccatggcagacagggagctgagcggcctgcggacccaggtgcaccagagcatggtgcccctgctcctacacctgaaggaccaatgcccagctgtcgccacgcaggccaagttcaccttctaccgctgtgctgtgctgctccgctggcggctactgcacaccctcttctgcacgctggcctgggagaggggcctcagcgcccgccacttcctctggacctgcctgatgacccgcagccaggaggaattcagcatccacttgtcacaggccctcagctacctgcacagccactcctgccacatcaagacctgggtgacactcttcataggccacaccatctgctaccacccccaggccgtgttccagatgctgaatgctgtggacaccaacctgctgttccgcacttttgaacatctcagaagtgaccctgagcccagcatccgggaattcgccaccagccagctctccttcctccagaaggtgtcggccagacccaagcagtgacctccagccatcctcccccacccaccgccttcccctcccgtgtccacctggtcagccctgccccatccgccccccacagagcttggttgcataacgtttttccatttgaaagaaagatctagattcaac

SEQ ID NO: 150532 - DNA, 613 bp, Homo sapiens
  Payload ID: 9733
  Gene Symbol: MROH5
  Gene Name: maestro heat-like repeat family member 5
  ENST ID: ENST00000521161
  CDS Start-End: 284-613
ctcagaacctgacacttgcacggaggccaggccgcaccaggcctacaggtgatgctgcctactcaacagtgtccttgaggcctcgagacccctgccctcctcccagggcccagccagtccattgaatggaaggacaaacacatggaaggatgcagctgagcccgatggaagtcaatgctgcgctcagcaccccctgtactaacgcagaaatatacacgcactcagatgccaacacccagggcccctcctccatttcagaatctccccccctgtctccacatccatgaaggactcatcttgcatgaaggtacaccaggactctgcccgcagggacagatggtcacaccccaccaccatcctgcttcacaagtcgcagagcagccaggccacactgatgctacaggagcacaggatgttcatgggggaagcctacagtgcagccaccggcttcaagatgctgcaggacatgaacagtgctgaccccttccacttgaagtacatcatcaagaagatcaagaacatggctcatggctcccccaagctggtgatggaaaccatccacgactacttcatagacaacccagagatctccagcaggcacaagttccggctg

SEQ ID NO: 150533 - DNA, 4164 bp, Homo sapiens
  Payload ID: 9733
  Gene Symbol: MROH5
  Gene Name: maestro heat-like repeat family member 5
  ENST ID: ENST00000430863
  CDS Start-End: 82-4038
agtgccgtagacagggccggcccacaggcgtgaggccagagttagtggtgagctcctgtgggtctgcactgcaccccaaccatggacaggcagtgttctgaaaggccatacagctgcaccccgacgggtagagtgtcgtcagccgtgtcccaaaactccagaatctccccccctgtctccacatccatgaaggactcatcttgcatgaaggtacaccaggactctgcccgcagggacagatggtcacaccccaccaccatcctgcttcacaagtcgcagagcagccaggccacactgatgctacaggagcacaggatgttcatgggggaagcctacagtgcagccaccggcttcaagatgctgcaggacatgaacagtgctgaccccttccacttgaagtacatcatcaagaagatcaagaacatggctcatggctcccccaagctggtgatggaaaccatccacgactacttcatagacaacccagagatctccagcaggcacaagttccggctgttccagaccctggagatggtcatcggggccagtgacgtcctggaggagacctgggagaaaactttcacacggctcgctctggagaacatgaccaaggccacggagctggaagacatataccaggacgcggccagcaacatgctggtggccatctgcaggcactcgtggcgggtggtggcgcagcatctggagacggagctcctgacgggcgtcttcccacacagaagcctcctctacgtgatgggcgtcctgtcctccagcgaggagctcttcagccaggaagacaaggcctgctgggaagagcaactgatccagatggccatcaagtcagtcccgttcctgagcacggatgtgtggtccaaggagctgctgtggacactcaccacgcccagctggacccaacaggagcagtcccctgagaaggccttcctgtttacctactatgggctaatccttcaagctgaaaaaaatggtgccacggtcaggagacacctgcaagccctcctggaaacatcccaccagtggcccaagcagagggagggcatggctctgaccttggggctggcggccacacgccacctggatgacgtctgggccgtcctggaccagtttggcaggagcaggcccatcagatggagtctccccagctcctccccaaagaactcggaggacctgcgctggaaatgggccagcagcaccatcctcctggcatacggccaggtggcagccaaagcccgggcccacatcctcccgtgggtggacaacatcgtgtccaggatggtcttctacttccactacagctcttgggacgagaccctgaagcagagcttcctcacagccaccctgatgctgatgggtgcggtgagccggagtgagggcgcccacagctacgagttcttccagacctctgagctcctccagtgtctgatggttttgatggagaaggagccccaggacactctgtgcacgcggagtcgccagcaggccatgcacatcgcgtccagcctctgcaagctgaggcctcccatagacttggaaaggaagtctcagctcctgtccacctgcttccgcagcgtgtttgccctgccactgctggatgccctggagaagcacacctgcctctttctggagcctcccaacatccagctgtggcccgtggctcgggagcgggcaggctggacgcaccagggctggggacccagggcagttcttcactgctctgagcacctacagagcctgtacagcaggaccatggaggcgctggacttcatgctgcaaagcctcatcatgcagaaccccaccgccgacgagctgcatttcctgctgtcgcacctgtacatctggctggcgtcggagaaggcgcatgagcggcagcgggctgtgcacagctgcatgatcctcctcaaattcctgaaccacaatggctacttggacccaaaagaggacttcaaaaggattgggcaattggtgggcatactggggatgctgtgccaggacccagacagggccacccagcgctgcagcctggaaggggcaagccatctctaccagctcttgatgtgccacaaaacaggagaagctttgcaggcagaatcacaggcccccaaggagctctcccaggcccattcggacggagccccactctggaacagcagagaccagaaggccactcccctgggcccccaggagatggcaaagaaccacatcttccagctctgcagcttccaagtcatcaaggatatcatgcagcagctcacactggcagagttgagcgacctcatctggacggccatcgacggcctgggctccaccagccccttccgcgtgcaggcagcctccgagatgctgctcacagccgtccaggagcacggggccaagctggagatcgtttccagcatggcccaggccatccgcctccgcctgtgctctgtccacatcccgcaagccaaggaaaagaccctgcacgccatcaccctgctggcccggagccacacctgtgagctggtggccaccttcctgaacatctccatccccttggacagccacaccttccagctgtggagggccctgggggctgggcagcccacgagccacctggtgctgaccacactgctggcctgtctgcaggagcgacccctgcccaccggtgccagcgacagcagcccctgccccaaggagaagacctacctgcgtttgctggctgccatgaacatgctgcacgagctgcagtttgcccgggagttcaagcaggccgtgcaggagggctaccccaagctcttcctggccctcctcacccagatgcactatgtcttggagctgaacctgcccagcgagccctagcccaagcagcaggcccaggaggcggccgtgcccagcccccaaagctgcagcacgtcactggaggcactgaagagcctgctgtccaccacggggcactggcatgactttgcccacctggagctgcagggatcctgggagctcttcaccaccatccacacctacccgaagggcgtgggcctccttgccagggccatggtgcagaaccactgcaggcagatcccagcggtgctgcgtcagctgctgcccagcctgcagagcccacaggagcgtgagaggaaggtggccatcctcatcctcaccaagttcctctacagccctgtcctgctggaggtgcttcccaaacaagctgccttgaccgtgctggcacaaggcctccacgaccccagccctgaggtccgcgtgttgagtctgcagggcctaagcaacatcctcttccacccagataagggaagcctgctccagggacagctgcggcccttgctcgacggcttcttccagagcagcgaccaggtgatcgtgtgcatcatgggcaccgtgtcagacacgctgcaccgcctgggcgcgcagggcacagggagtcagagcctcggcgttgccatcagcacacgctccttctttaatgacgagcgggacgggattcgggcggcagccatggcactgttcggggacctggtggcggccatggcagacagggagctgagcggcctgcggacccaggtgcaccagagcatggtgcccctgctcctacacctgaaggaccaatgcccagctgtcgccacgcaggccaagttcaccttctaccgctgtgctgtgctgctccgctggcggctactgcacaccctcttctgcacgctggcctgggagaggggcctcagcgcccgccacttcctctggacctgcctgatgacccgcagccaggaggaattcagcatccacttgtcacaggccctcagctacctgcacagccactcctgccacatcaagacctgggtgacactcttcataggccacaccatctgctaccacccccaggccgtgttccagatgctgaatgctgtggacaccaacctgctgttccgcacttttgaacatctcagaagtgaccctgagcccagcatccgggaattcgccaccagccagctctccttcctccagaaggtgtcggccagacccaagcagtgacctccagccatcctcccccacccaccgccttcccctcccgtgtccacctggtcagccctgccccatccgccccccacagagcttggttgcataacgtttttccatttgaaagaaagatctagattc

SEQ ID NO: 150534 - DNA, 4164 bp, Homo sapiens
  Payload ID: 9733
  Gene Symbol: MROH5
  Gene Name: maestro heat-like repeat family member 5
  ENST ID: ENST00000621837
  CDS Start-End: 82-4035
agtgccgtagacagggccggcccacaggcgtgaggccagagttagtggtgagctcctgtgggtctgcactgcaccccaaccatggacaggcagtgttctgaaaggccatacagctgcaccccgacgggtagagtgtcgtcagccgtgtcccaaaactccagaatctccccccctgtctccacatccatgaaggactcatcttgcatgaaggtacaccaggactctgcccgcagggacagatggtcacaccccaccaccatcctgcttcacaagtcgcagagcagccaggccacactgatgctacaggagcacaggatgttcatgggggaagcctacagtgcagccaccggcttcaagatgctgcaggacatgaacagtgctgaccccttccacttgaagtacatcatcaagaagatcaagaacatggctcatggctcccccaagctggtgatggaaaccatccacgactacttcatagacaacccagagatctccagcaggcacaagttccggctgttccagaccctggagatggtcatcggggccagtgacgtcctggaggagacctgggagaaaactttcacacggctcgctctggagaacatgaccaaggccacggagctggaagacatataccaggacgcggccagcaacatgctggtggccatctgcaggcactcgtggcgggtggtggcgcagcatctggagacggagctcctgacgggcgtcttcccacacagaagcctcctctacgtgatgggcgtcctgtcctccagcgaggagctcttcagccaggaagacaaggcctgctgggaagagcaactgatccagatggccatcaagtcagtcccgttcctgagcacggatgtgtggtccaaggagctgctgtggacactcaccacgcccagctggacccaacaggagcagtcccctgagaaggccttcctgtttacctactatgggctaatccttcaagctgaaaaaaatggtgccacggtcaggagacacctgcaagccctcctggaaacatcccaccagtggcccaagcagagggagggcatggctctgaccttggggctggcggccacacgccacctggatgacgtctgggccgtcctggaccagtttggcaggagcaggcccatcagatggagtctccccagctcctccccaaagaactcggaggacctgcgctggaaatgggccagcagcaccatcctcctggcatacggccaggtggcagccaaagcccgggcccacatcctcccgtgggtggacaacatcgtgtccaggatggtcttctacttccactacagctcttgggacgagaccctgaagcagagcttcctcacagccaccctgatgctgatgggtgcggtgagccggagtgagggcgcccacagctacgagttcttccagacctctgagctcctccagtgtctgatggttttgatggagaaggagccccaggacactctgtgcacgcggagtcgccagcaggccatgcacatcgcgtccagcctctgcaagctgaggcctcccatagacttggaaaggaagtctcagctcctgtccacctgcttccgcagcgtgtttgccctgccactgctggatgccctggagaagcacacctgcctctttctggagcctcccaacatccagctgtggcccgtggctcgggagcgggcaggctggacgcaccagggctggggacccagggcagttcttcactgctctgagcacctacagagcctgtacagcaggaccatggaggcgctggacttcatgctgcaaagcctcatcatgcagaaccccaccgccgacgagctgcatttcctgctgtcgcacctgtacatctggctggcgtcggagaaggcgcatgagcggcagcgggctgtgcacagctgcatgatcctcctcaaattcctgaaccacaatggctacttggacccaaaagaggacttcaaaaggattgggcaattggtgggcatactggggatgctgtgccaggacccagacagggccacccagcgctgcagcctggaaggggcaagccatctctaccagctcttgatgtgccacaaaacaggagaagctttgcaggcagaatcacaggcccccaaggagctctcccaggcccattcggacggagccccactctggaacagcagagaccagaaggccactcccctgggcccccaggagatggcaaagaaccacatcttccagctctgcagcttccaagtcatcaaggatatcatgcagcagctcacactggcagagttgagcgacctcatctggacggccatcgacggcctgggctccaccagccccttccgcgtgcaggcagcctccgagatgctgctcacagccgtccaggagcacggggccaagctggagatcgtttccagcatggcccaggccatccgcctccgcctgtgctctgtccacatcccgcaagccaaggaaaagaccctgcacgccatcaccctgctggcccggagccacacctgtgagctggtggccaccttcctgaacatctccatccccttggacagccacaccttccagctgtggagggccctgggggctgggcagcccacgagccacctggtgctgaccacactgctggcctgtctgcaggagcgacccctgcccaccggtgccagcgacagcagcccctgccccaaggagaagacctacctgcgtttgctggctgccatgaacatgctgcacgagctgcagtttgcccgggagttcaagcaggccgtgcaggagggctaccccaagctcttcctggccctcctcacccagatgcactatgtcttggagctgaacctgcccagcgagccccccaagcagcaggcccaggaggcggccgtgcccagcccccaaagctgcagcacgtcactggaggcactgaagagcctgctgtccaccacggggcactggcatgactttgcccacctggagctgcagggatcctgggagctcttcaccaccatccacacctacccgaagggcgtgggcctccttgccagggccatggtgcagaaccactgcaggcagatcccagcggtgctgcgtcagctgctgcccagcctgcagagcccacaggagcgtgagaggaaggtggccatcctcatcctcaccaagttcctctacagccctgtcctgctggaggtgcttcccaaacaagctgccttgaccgtgctggcacaaggcctccacgaccccagccctgaggtccgcgtgttgagtctgcagggcctaagcaacatcctcttccacccagataagggaagcctgctccagggacagctgcggcccttgctcgacggcttcttccagagcagcgaccaggtgatcgtgtgcatcatgggcaccgtgtcagacacgctgcaccgcctgggcgcgcagggcacagggagtcagagcctcggcgttgccatcagcacacgctccttctttaatgacgagcgggacgggattcgggcggcagccatggcactgttcggggacctggtggcggccatggcagacagggagctgagcggcctgcggacccaggtgcaccagagcatggtgcccctgctcctacacctgaaggaccaatgcccagctgtcgccacgcaggccaagttcaccttctaccgctgtgctgtgctgctccgctggcggctactgcacaccctcttctgcacgctggcctgggagaggggcctcagcgcccgccacttcctctggacctgcctgatgacccgcagccaggaggaattcagcatccacttgtcacaggccctcagctacctgcacagccactcctgccacatcaagacctgggtgacactcttcataggccacaccatctgctaccacccccaggccgtgttccagatgctgaatgctgtggacaccaacctgctgttccgcacttttgaacatctcagaagtgaccctgagcccagcatccgggaattcgccaccagccagctctccttcctccagaaggtgtcggccagacccaagcagtgacctccagccatcctcccccacccaccgccttcccctcccgtgtccacctggtcagccctgccccatccgccccccacagagcttggttgcataacgtttttccatttgaaagaaagatctagattcaac

SEQ ID NO: 150535 - DNA, 1606 bp, Homo sapiens
  Payload ID: 9733
  Gene Symbol: MROH5
  Gene Name: maestro heat-like repeat family member 5
  ENST ID: ENST00000632233
  CDS Start-End: 1-1480
ccacaccttccagctgtggagggccctgggggctgggcagcccacgagccacctggtgctgaccacactgctggcctgtctgcaggagcgacccctgcccaccggtgccagcgacagcagcccctgccccaaggagaagacctacctgcgtttgctggctgccatgaacatgctgcacgagctgcagtttgcccgggagttcaagcaggccgtgcaggagggctaccccaagctcttcctggccctcctcacccagatgcactatgtcttggagctgaacctgcccagcgagccctagcccaagcagcaggcccaggaggcggccgtgcccagcccccaaagctgcagcacgtcactggaggcactgaagagcctgctgtccaccacggggcactggcatgactttgcccacctggagctgcagggatcctgggagctcttcaccaccatccacacctacccgaagggcgtgggcctccttgccagggccatggtgcagaaccactgcaggcagatcccagcggtgctgcgtcagctgctgcccagcctgcagagcccacaggagcgtgagaggaaggtggccatcctcatcctcaccaagttcctctacagccctgtcctgctggaggtgcttcccaaacaagctgccttgaccgtgctggcacaaggcctccacgaccccagccctgaggtccgcgtgttgagtctgcagggcctaagcaacatcctcttccacccagataagggaagcctgctccagggacagctgcggcccttgctcgacggcttcttccagagcagcgaccaggtgatcgtgtgcatcatgggcaccgtgtcagacacgctgcaccgcctgggcgcgcagggcacagggagtcagagcctcggcgttgccatcagcacacgctccttctttaatgacgagcgggacgggattcgggcggcagccatggcactgttcggggacctggtggcggccatggcagacagggagctgagcggcctgcggacccaggtgcaccagagcatggtgcccctgctcctacacctgaaggaccaatgcccagctgtcgccacgcaggccaagttcaccttctaccgctgtgctgtgctgctccgctggcggctactgcacaccctcttctgcacgctggcctgggagaggggcctcagcgcccgccacttcctctggacctgcctgatgacccgcagccaggaggaattcagcatccacttgtcacaggccctcagctacctgcacagccactcctgccacatcaagacctgggtgacactcttcataggccacaccatctgctaccacccccaggccgtgttccagatgctgaatgctgtggacaccaacctgctgttccgcacttttgaacatctcagaagtgaccctgagcccagcatccgggaattcgccaccagccagctctccttcctccagaaggtgtcggccagacccaagcagtgacctccagccatcctcccccacccaccgccttcccctcccgtgtccacctggtcagccctgccccatccgccccccacagagcttggttgcataacgtttttccatttgaaagaaagatctagattc

SEQ ID NO: 150536 - DNA, 3469 bp, Homo sapiens
  Payload ID: 9734
  Gene Symbol: MROH6
  Gene Name: maestro heat-like repeat family member 6
  Uniprot ID: A6NGR9
  ENST ID: ENST00000398882
  CDS Start-End: 258-2417
gttctcagggccctggtgggtagagccacaccacaggcactcaggctgcaggtggccactcccctccagcagcccaggcaggagggcccctcaaaggcccattgtaggcacgtccgtgtggctccccagcccccgcaagctcacgctagcgcacgccaccacgcccgtccgtggtcccgcccggggcggcttctaggtcagtcctgggcacaacttcgcaggaggagcagcggcaggtgctgcaggcaagggccgccatggctgggggtgtgtggggccggagccgggcccgggaggctcccgtgggggctctaaccctgacagcactgactgaaggaatccgggccaggcaggggcagccccagggacccccttccgcaggccctcagcccaagtcctgggaggtcaaacctgaggctgagccacagacccaggcactcaccgccccctctgaggcagagcctggacgtggggccaccgtccctgaagctggcagcgagccctgctccctcaacagtgccctggaaccagcccctgaggggccccaccaggttccccagagttcctgggaggagggagttcttgccgacctcgcgttgtacacggctgcctgcctggaggaggctggctttgcagggacccaggcgacagtgctcaccctgtcctcagccctggaggcccggggcgagcggttggaggaccaggtgcatgctctggtgcgtgggctgctggcgcaggtgcccagcctagcggaggggaggccctggagggcggccctgcgagtgctgagcgcactggccctggagcatgcgcgggacgtggtgtgtgcgctgctaccccgctctctgcccgccgatcgggtagcagccgagctctggcgcagcctaagccgtaaccagcgtgtaaatgggcaggtgctggtgcaactgctgtgggcgctgaagggtgcttcggggccggagccccaggcactggcggccacacgtgctcttggggagatgctggctgtttcgggctgcgtgggagccacgaggggcttctacccacatctgctgcttgcgctggtcacacagctgcacaagctggcccgcagcccgtgctcccccgacatgcccaagatttgggttctgtcccaccgagggccaccacatagccatgccagctgtgctgtggaggccttgaaggcgctgctcaccggggatggaggccgcatggtggtcacgtgcatggagcaggcaggaggctggaggaggctggtgggagcccacacccacctggagggcgtcctgctgctggccagtgctatggtggcacatgccgaccaccacctgcgaggcctcttcgcagacttgctccctcggcttcgcagcgcggacgacccgcagcgtctcacggctatggccttcttcacagggctgttgcagagccggcccaccgcacggctcctgcgggaggaggtcatcctggagcgactcctcacctggcagggagaccccgaacccactgtgcgctggttgggcctgctgggcctgggccacctcgcgctgaatcgcaggaaggtgcggcacgtgagcacgctgctgccggcgctcctgggcgcactgggcgaaggcgacgcgcggctcgtgggtgcagcgctgggcgccctgaggaggctcctgctgcggccccgggcgcctgtgcggctcctgagcgcggagctgggaccgcgcctccctccgctactggacgacacacgggactcaatccgcgcctcggccgtcgggctccttgggactctggtgcgccggggccggggcgggctccggctggggctccgcggccccctgcggaagctggtgctgcagagtctcgtgccgctgctgctgcgcctgcatgaccccagcagggacgctgctgagagctcagagtggaccctggcccgctgtgaccacgccttttgctggggcctgctggaggagttggtcaccgtggcccactatgacagccccgaggccctgagccacctctgctgccgcctggttcagcgatacccaggccacgtgcccaacttcctgagccagacccagggctacctgcggagtccacaggaccccctgcgccgggcagccgccgtgcttataggcttccttgtccaccacgccagccccggctgtgtcaaccaggacctgctggactccctgttccaggacctagggcgactgcagagcgaccccaagccggctgtggccgcggcagcgcacgtgtccgctcagcaggtggcgatgctggcccgtgcccggggctgcccccgcgggccccgccttctccgcatcgccccgcgccccgcccggcccccaccagtcttcgccgacagccccttccagcgccggagcgtcgcgggccgctggggctgctccggaccccgccgagcctgaggctcggggctggggcccgagggccagggtccgactcgggcaccccacgcgcatagcagcctgtccccgccctgacggaggggctccctgggcctggtgctggacgccaatgccctcccccaccccccacccccgtgacccctcttcaggcacccaccaccctgatggtgacagagggggacagccagcacccatctgtccccgtcagggctcttgttctcacagccccctggagcatgccccatgccccaaccttgggcctggctcctggcccagatggcacctggcctcttgagtctgctgggggaccccaaagttggtggtcccatagcctgccctcctgggtctccacctcatgcctggacaggacgctgtggcctgtccgggccttggccagccctgcagctgcacccccgatcctcatccctcaccccattccctgccagcatcctaaggctcctggcgggcatcctctctgctcaaaattattgacctgtctcccggccacacctgctgtgccctctcagccaggccatcatcaccccctgttcattatgtcaggcctcatgggagcctggccttctccagaagctggccccggcgtcctcccaagctggaccacgtaggccccagatcacacctgggggtccagatgtaggggtcctgtgtgcacgcccaatcagaccgagcacttgtgacactaccccaacacctctcccagggctgaatgaggaacgcgccactggacacatgaggaagaggctgctctgggagctactgatgctgtgacctcacctctctggctttgggcggcaggtccctgcacctaggatgcctgcctggaaatgtccttgcattcgtggcctccttcacagcctcctcctcagagaagcctctgcgagtgcacagggagtgtgtgcagccttgtgaagggctgggaccacttgcccagactggggcccctcaggcacaggcgtggggtcctactgacctgtctccccagctcccacacagaaagcatctaaaataaacacacgtggatggaaagcgtt

SEQ ID NO: 150537 - DNA, 1789 bp, Homo sapiens
  Payload ID: 9734
  Gene Symbol: MROH6
  Gene Name: maestro heat-like repeat family member 6
  ENST ID: ENST00000534459
  CDS Start-End: 700-852
aggcttcccaaccaggtccagctccaggccctgttccctgtccccagatcacaccgagtcagcagccttccctagacccgccgcttcctcgctccgcgctggccgccccctcccacccttgcagcccctctctgtctccgcctgccctgactgcgccctcccacgcagacacgggactcaatccgcgcctcggccgtcgggctccttgggactctggtgcgccggggccggggcgggctccggctggggctccgcggccccctgcggaagctggtgctgcagagtctcgtgccgctgctgctgcgcctgcatgaccccagcagggacgctgctgagagctcagagtggaccctggcccgctgtgaccacgccttttgctggggcctgctggaggagttggtcaccgtggcccactatgacagccccgaggccctgagccacctctgctgccgcctggttcagcgatacccaggccacgtgcccaacttcctgagccagacccagggctacctgcggagtccacaggaccccctgcgccgggcagccgccgtgcttataggcttccttgtccaccacgccagccccggctgtgtcaaccaggacctgctggactccctgttccaggacctagggcgactgcagagcgaccccaagccggctgtggccgcggcagcgcacgtgtccgctcagcaggtggcgatgctggcccgtgcccggggctgcccccgcgggccccgccttctccgcatcgccccgcgccccgcccggcccccaccagtcttcgccgacagccccttccagcgccggagcgtcgcgggccgctggggctgctccggaccccgccgagcctgaggctcggggctggggcccgagggccagggtccgactcgggcaccccacgcgcatagcagcctgtccccgccctgacggaggggctccctgggcctggtgctggacgccaatgccctcccccaccccccacccccgtgacccctcttcaggcacccaccaccctgatggtgacagagggggacagccagcacccatctgtccccgtcagggctcttgttctcacagccccctggagcatgccccatgccccaaccttgggcctggctcctggcccagatggcacctggcctcttgagtctgctgggggaccccaaagttggtggtcccatagcctgccctcctgggtctccacctcatgcctggacaggacgctgtggcctgtccgggccttggccagccctgcagctgcacccccgatcctcatccctcaccccattccctgccagcatcctaaggctcctggcgggcatcctctctgctcaaaattattgacctgtctcccggccacacctgctgtgccctctcagccaggccatcatcaccccctgttcattatgtcaggcctcatgggagcctggccttctccagaagctggccccggcgtcctcccaagctggaccacgtaggccccagatcacacctgggggtccagatgtaggggtcctgtgtgcacgcccaatcagaccgagcacttgtgacactaccccaacacctctcccagggctgaatgaggaacgcgccactggacacatgaggaagaggctgctctgggagctactgatgctgtgacctcacctctctggctttgggcggcaggtccctgcacctaggatgcctgcctggaaatgtccttgcattcgtggcctccttcacagcctcctcctcagagaagcctctgcgagtgcacagggagtgtgtgcagccttgtgaagggctg

SEQ ID NO: 150538 - DNA, 1921 bp, Homo sapiens
  Payload ID: 9734
  Gene Symbol: MROH6
  Gene Name: maestro heat-like repeat family member 6
  ENST ID: ENST00000533679
  CDS Start-End: 722-874
gtgcgctggttgggcctgctgggcctgggccacctcgcgctgaatcgcaggaaggtgtgagagaaggggaggggtggagaggggcttggcccggtcgcggcgaggtctgcaagaggctgaccccgagtcccagcaggtgcggcacgtgagcacgctgctgccggcgctcctgggcgcactgggcgaaggcgacgcgcggctcgtgggtgcagcgctgggcgccctgaggaggctcctgctgcggccccgggcgcctgtgcggctcctgagcgcggagctgggaccgcgcctccctccgctactggacgacacacgggactcaatccgcgcctcggccgtcgggctccttgggactctggtgcgccggggccggggcgggctccggctggggctccgcggccccctgcggaagctggtgctgcagagtctcgtgccgctgctgctgcgcctgcatgaccccagcagggacgctgctgaggttcagcgatacccaggccacgtgcccaacttcctgagccagacccagggctacctgcggagtccacaggaccccctgcgccgggcagccgccgtgcttataggcttccttgtccaccacgccagccccggctgtgtcaaccaggacctgctggactccctgttccaggacctagggcgactgcagagcgaccccaagccggctgtggccgcggcagcgcacgtgtccgctcagcaggtggcgatgctggcccgtgcccggggctgcccccgcgggccccgccttctccgcatcgccccgcgccccgcccggcccccaccagtcttcgccgacagccccttccagcgccggagcgtcgcgggccgctggggctgctccggaccccgccgagcctgaggctcggggctggggcccgagggccagggtccgactcgggcaccccacgcgcatagcagcctgtccccgccctgacggaggggctccctgggcctggtgctggacgccaatgccctcccccaccccccacccccgtgacccctcttcaggcacccaccaccctgatggtgacagagggggacagccagcacccatctgtccccgtcagggctcttgttctcacagccccctggagcatgccccatgccccaaccttgggcctggctcctggcccagatggcacctggcctcttgagtctgctgggggaccccaaagttggtggtcccatagcctgccctcctgggtctccacctcatgcctggacaggacgctgtggcctgtccgggccttggccagccctgcagctgcacccccgatcctcatccctcaccccattccctgccagcatcctaaggctcctggcgggcatcctctctgctcaaaattattgacctgtctcccggccacacctgctgtgccctctcagccaggccatcatcaccccctgttcattatgtcaggcctcatgggagcctggccttctccagaagctggccccggcgtcctcccaagctggaccacgtaggccccagatcacacctgggggtccagatgtaggggtcctgtgtgcacgcccaatcagaccgagcacttgtgacactaccccaacacctctcccagggctgaatgaggaacgcgccactggacacatgaggaagaggctgctctgggagctactgatgctgtgacctcacctctctggctttgggcggcaggtccctgcacctaggatgcctgcctggaaatgtccttgcattcgtggcctccttcacagcctcctcctcagagaagcctctgcgagtgcacagggagtgtgtgcagccttgtgaagggctgggaccacttgcccagactggggcccctcaggcacaggcgtggggtcctactgacctgtctccccagctcccacacagaaagcatctaaaataaacacacgtggatggaaa

SEQ ID NO: 150539 - DNA, 1794 bp, Homo sapiens
  Payload ID: 9734
  Gene Symbol: MROH6
  Gene Name: maestro heat-like repeat family member 6
  ENST ID: ENST00000524906
  CDS Start-End: 601-753
ttccctgtccccagatcacaccgagtcagcagccttccctagacccgccgcttcctcgctccgcgctggccgccccctcccacccttgcagcccctctctgtctccgcctgccctgactgcgccctcccacgcagacacgggactcaatccgcgcctcggccgtcgggctccttgggactctggtgcgccggggccggggcgggctccggctggggctccgcggccccctgcggaagctggtgctgcagagtctcgtgccgctgctgctgcgcctgcatgaccccagcagggacgctgctgagagctcagagtggaccctggcccgctgtgaccacgccttttgctggggcctgctggaggagttggtcaccgtggcccactatgacagccccgaggccctgagccacctctgctgccgcctggttcagcgatacccaggccacgtgcccaacttcctgagccagacccagggctacctgcggagtccacaggaccccctgcgccgggcagccgccgtgcttatagacctagggcgactgcagagcgaccccaagccggctgtggccgcggcagcgcacgtgtccgctcagcaggtggcgatgctggcccgtgcccggggctgcccccgcgggccccgccttctccgcatcgccccgcgccccgcccggcccccaccagtcttcgccgacagccccttccagcgccggagcgtcgcgggccgctggggctgctccggaccccgccgagcctgaggctcggggctggggcccgagggccagggtccgactcgggcaccccacgcgcatagcagcctgtccccgccctgacggaggggctccctgggcctggtgctggacgccaatgccctcccccaccccccacccccgtgacccctcttcaggcacccaccaccctgatggtgacagagggggacagccagcacccatctgtccccgtcagggctcttgttctcacagccccctggagcatgccccatgccccaaccttgggcctggctcctggcccagatggcacctggcctcttgagtctgctgggggaccccaaagttggtggtcccatagcctgccctcctgggtctccacctcatgcctggacaggacgctgtggcctgtccgggccttggccagccctgcagctgcacccccgatcctcatccctcaccccattccctgccagcatcctaaggctcctggcgggcatcctctctgctcaaaattattgacctgtctcccggccacacctgctgtgccctctcagccaggccatcatcaccccctgttcattatgtcaggcctcatgggagcctggccttctccagaagctggccccggcgtcctcccaagctggaccacgtaggccccagatcacacctgggggtccagatgtaggggtcctgtgtgcacgcccaatcagaccgagcacttgtgacactaccccaacacctctcccagggctgaatgaggaacgcgccactggacacatgaggaagaggctgctctgggagctactgatgctgtgacctcacctctctggctttgggcggcaggtccctgcacctaggatgcctgcctggaaatgtccttgcattcgtggcctccttcacagcctcctcctcagagaagcctctgcgagtgcacagggagtgtgtgcagccttgtgaagggctgggaccacttgcccagactggggcccctcaggcacaggcgtggggtcctactgacctgtctccccagctcccacacagaaagcatctaaaataaacacacgtgga

SEQ ID NO: 150540 - DNA, 572 bp, Homo sapiens
  Payload ID: 9734
  Gene Symbol: MROH6
  Gene Name: maestro heat-like repeat family member 6
  ENST ID: ENST00000532862
  CDS Start-End: 553-572
gccctgttccctgtccccagatcacaccgagtcagcagccttccctagacccgccgcttcctcgctccgcgctggccgccccctcccacccttgcagcccctctctgtctccgcctgccctgactgcgccctcccacgcagacacgggactcaatccgcgcctcggccgtcgggctccttgggactctggtgcgccggggccggggcgggctccggctggggctccgcggccccctgcggaagctggtgctgcagagtctcgtgccgctgctgctgcgcctgcatgaccccagcagggacgctgctgaggttcagcgatacccaggccacgtgcccaacttcctgagccagacccagggctacctgcggagtccacaggaccccctgcgccgggcagccgccgtgcttataggcttccttgtccaccacgccagccccggctgtgtcaaccaggacctgctggactccctgttccaggacctagggcgactgcagagcgaccccaagccggctgtggccgcggcagcgcacgtgtccgctcagcaggtggcgatgctggcccgtgcccgggg

SEQ ID NO: 150541 - DNA, 1680 bp, Homo sapiens
  Payload ID: 9734
  Gene Symbol: MROH6
  Gene Name: maestro heat-like repeat family member 6
  ENST ID: ENST00000529971
  CDS Start-End: 35-1680
ggagcagcggcaggtgctgcaggcaagggccgccatggctgggggtgtgtggggccggagccgggcccgggaggctcccgtgggggctctaaccctgacagcactgactgaaggaatccgggccaggcaggggcagccccagggacccccttccgcaggccctcagcccaagtcctgggaggtcaaacctgaggctgagccacagacccaggcactcaccgccccctctgaggcagagcctggacgtggggccaccgtccctgaagctggcagcgagccctgctccctcaacagtgccctggaaccagcccctgaggggccccaccaggttccccagagttcctgggaggagggagttcttgccgacctcgcgttgtacacggctgcctgcctggaggaggctggctttgcagggacccaggcgacagtgctcaccctgtcctcagccctggaggcccggggcgagcggttggaggaccaggtgcatgctctggtgcgtgggctgctggcgcaggtgcccagcctagcggaggggaggccctggagggcggccctgcgagtgctgagcgcactggccctggagcatgcgcgggacgtggtgtgtgcgctgctaccccgctctctgcccgccgatcgggtagcagccgagctctggcgcagcctaagccgtaaccagcgtgtaaatgggcaggtgctggtgcaactgctgtgggcgctgaagggtgcttcggggccggagccccaggcactggcggccacacgtgctcttggggagatgctggctgtttcgggctgcgtgggagccacgaggggcttctacccacatctgctgcttgcgctggtcacacagctgcacaagctggcccgcagcccgtgctcccccgacatgcccaagatttgggttctgtcccaccgagggccaccacatagccatgccagctcccactgcccacctgctcactgtccccaccaccagctgtgctgtggaggccttgaaggcgctgctcaccggggatggaggccgcatggtggtcacgtgcatggagcaggcaggaggctggaggaggctggtgggagcccacacccacctggagggcgtcctgctgctggccagtgctatggtggcacatgccgaccaccacctgcgaggcctcttcgcagacttgctccctcggcttcgcagcgcggacgacccgcagcgtctcacggctatggccttcttcacagggctgttgcagagccggcccaccgcacggctcctgcgggaggaggtcatcctggagcgactcctcacctggcagggagaccccgaacccactgtgcgctggttgggcctgctgggcctgggccacctcgcgctgaatcgcaggaaggtgcggcacgtgagcacgctgctgccggcgctcctgggcgcactgggcgaaggcgacgcgcggctcgtgggtgcagcgctgggcgccctgaggaggctcctgctgcggccccgggcgcctgtgcggctcctgagcgcggagctgggaccgcgcctccctccgctactggacgacacacgggactcaatccgcgcctcggccgtcgggctccttgggactctggtgcgccggggccggggcgggctccggctggggctccgcggccccctgcggaagctggtgctgcagagtctcgtgccgctgctgc

SEQ ID NO: 150542 - DNA, 3469 bp, Homo sapiens; identical to SEQ ID NO: 150536
  Payload ID: 9734
  Gene Symbol: MROH6
  Gene Name: maestro heat-like repeat family member 6
  Uniprot ID: A6NGR9
  ENST ID: ENST00000618551
  CDS Start-End: 258-2417

SEQ ID NO: 150543 - DNA, 1680 bp, Homo sapiens; identical to SEQ ID NO: 150541
  Payload ID: 9734
  Gene Symbol: MROH6
  Gene Name: maestro heat-like repeat family member 6
  ENST ID: ENST00000633027
  CDS Start-End: 35-1680

SEQ ID NO: 150544 - DNA, 3459 bp, Homo sapiens
  Payload ID: 9735
  Gene Symbol: MROH7
  Gene Name: maestro heat-like repeat family member 7
  ENST ID: ENST00000339553
  CDS Start-End: 325-3459
actggcctgggctggggaagcctaggtaagctgaggggcagctctgggaaagtcctaggggtgggggcagtctccacagcctcccacaagggagttaccaccttcccgcacttctgggtacaagtctcctgctctggctgtattccacagttagaacttcatatctttggcttagagctggattttctgttaccatgtggatgctccaggtgaaggggcccgctcctgcttaaaaacaccatgcatgcagactgctgctgggaatgtgacagttggctgttggagagaagcgggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgagcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagcaaccctgcgaagaaggaattgtgatactcatgcttaggatctcatgggaaaggcaacaacaagcagtcacaggggctcggagctggagagtgacacactcagctttgccacatggtgctgatggacatcagacggagacttccagcaatctgttggttttgcaagtctga

SEQ ID NO: 150545 - DNA, 3413 bp, Homo sapiens
  Payload ID: 9735
  Gene Symbol: MROH7
  Gene Name: maestro heat-like repeat family member 7
  Uniprot ID: Q68CQ1
  ENST ID: ENST00000395690
  CDS Start-End: 257-3349
agtctccacagcctcccacaagggagttaccaccttcccgcacttctgggtacaagtctcctgctctggctgtattccacagttagaacttcatatctttggcttagagctggattttctgttaccatgtggatgctccaggtgaaggggcccgctcctgcttaaaaacaccatgcatgcagactgctgctgggaatgtgacagttggctgttggagagaagcgggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgagcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagcaaccctgcgaagaaggaattgtgatactcatgcttaggccacaggatctcatgggaaaggcaacaacaagcagtcacaggggctcggagctggagagtgacacactcagctttgccacatggtgctgatggacatcagacggagacttccagcaatctgttggttttgcaagtctgaagctccgggcagagc

SEQ ID NO: 150546 - DNA, 2977 bp, Homo sapiens
  Payload ID: 9735
  Gene Symbol: MROH7
  Gene Name: maestro heat-like repeat family member 7
  ENST ID: ENST00000409996
  CDS Start-End: 227-2902
ctaggggtgggggcagtctccacagcctcccacaagggagttaccaccttcccgcacttctgggtacaagtctcctgctctggctgtattccacagttagaacttcatatctttggcttagagctggattttctgttaccatgtggatgctccaggtgaaggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggtcgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttacc

SEQ ID NO: 150547 - DNA, 4174 bp, Homo sapiens
  Payload ID: 9735
  Gene Symbol: MROH7
  Gene Name: maestro heat-like repeat family member 7
  Uniprot ID: Q68CQ1
  ENST ID: ENST00000422659
  CDS Start-End: 114-1997
ccaggggcccgctcctgcttaaaaacaccatgcatgcagactgctgctgggaatgtgacagttggctgttggagagaagcgggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgagcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggtcgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggctta

SEQ ID NO: 150548 - DNA, 4542 bp, Homo sapiens
  Payload ID: 9735
  Gene Symbol: MROH7
  Gene Name: maestro heat-like repeat family member 7
  Uniprot ID: Q68CQ1
  ENST ID: ENST00000413188
  CDS Start-End: 822-2705
tagaaattggcagagaacaaggcagatgcagtttctgcatcagtggagctcattggctagtggggaagccagataccgtgagccaagagacgggaaggaacaaggtggcctgagaactttcaggtggcccccacctgtctaggggacctggaaggctcttagcatttgagctgaaacctgaaagggtgaagcagcagtcattagctggggaaggggagtggagatggatgcccagcctgtggaagacccagacctaactgggagagcctgcctctttggaggaagtcaaaagaactctgcaagggtggaacggaaaaggaaagggacatatggaggggcaaaaagggtgaaaaggggactggggccagatacagagggccttttgggtctgctaacaactggaggactctatcctaaagataacaggaagccatggaggggtttaggcaaggggatggcttagagatggtgttggctgcccagaaggccagtggggtgagtgaccttcctctctttgaccttcacttccttatgtataaatattaaacttactctctctctctctctctctctctgtgtgtgtgtgtttgtgtgtgtgtgtgtgtagtgcggagcttgttaacagacgtgcatgcctggcctgtggactgtgcagtaagtgttgaaaaaggcactcttccctgacttgatttctttctgcatctcctcccaggggcccgctcctgcttaaaaacaccatgcatgcagactgctgctgggaatgtgacagttggctgttggagagaagcgggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgagcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggtcgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttacctctc

SEQ ID NO: 150549 - DNA, 4329 bp, Homo sapiens
  Payload ID: 9735
  Gene Symbol: MROH7
  Gene Name: maestro heat-like repeat family member 7
  Uniprot ID: Q68CQ1
  ENST ID: ENST00000421030
  CDS Start-End: 286-4257
agctctgggaaagtcctaggggtgggggcagtctccacagcctcccacaagggagttaccaccttcccgcacttctgggtacaagtctcctgctctggctgtattccacagttagaacttcatatctttggcttagagctggattttctgttaccatgtggatgctccaggtgaaggggcccgctcctgcttaaaaacaccatgcatgcagactgctgctgggaatgtgacagttggctgttggagagaagcgggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgagcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggtcgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggctt

SEQ ID NO: 150550 - DNA, 2658 bp, Homo sapiens
  Payload ID: 9735
  Gene Symbol: MROH7
  Gene Name: maestro heat-like repeat family member 7
  ENST ID: ENST00000440217
  CDS Start-End: 137-349
gttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacaggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggtcgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttac

SEQ ID NO: 150551 - DNA, 4148 bp, Homo sapiens
  Payload ID: 9735
  Gene Symbol: MROH7
  Gene Name: maestro heat-like repeat family member 7
  ENST ID: ENST00000440047
  CDS Start-End: 278-2542
gaaagtcctaggggtgggggcagtctccacagcctcccacaagggagttaccaccttcccgcacttctgggtacaagtctcctgctctggctgtattccacagttagaacttcatatctttggcttagagctggattttctgttaccatgtggatgctccaggtgaaggggcccgctcctgcttaaaaacaccatgcatgcagactgctgctgggaatgtgacagttggctgttggagagaagcgggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgagcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggtcgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccct

SEQ ID NO: 150552 - DNA, 3362 bp, Homo sapiens
  Payload ID: 9735
  Gene Symbol: MROH7
  Gene Name: maestro heat-like repeat family member 7
  Uniprot ID: Q68CQ1
  ENST ID: ENST00000438846
  CDS Start-End: 37-1920
agcgggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgagcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagactcccctagtgcccagggaaccaccaacctttgctgggcacctctgtgtgtcaggcacgagacatataaatgtgaatttgactctaccctgccctcaaggaatttttggtgtggcagaggacacagaggacaccccagttataacagggggtgataccacaaccctgcgaagaaggaattgtgatactcatgcttaggatctcatgggaaaggcaacaacaagcagtcacaggggctcggagctggagagtgacacactcagctttgccacatggtgctgatggacatcagacggagacttccagcaatctgttggttttgcaagtctgaagctccgggcagagc

SEQ ID NO: 150553 - DNA, 3425 bp, Homo sapiens
  Payload ID: 9736
  Gene Symbol: MROH8
  Gene Name: maestro heat-like repeat family member 8
  ENST ID: ENST00000343811
  CDS Start-End: 1-3209
aggtcgcgggcactcccaccagctcgcagccctccttcggaccctcgatccgagagcgccccagccagagcttgtgcccatgcccctgtcccgcaggggaaggggatcccgcctggccggctctcgagcggcgactagtaacctcccgcgggcgacagccctctccccaaagccacgcgcaactcctcacccggcggcgccattcctccgagcaggtcccgccggagtccgagccgcgggctgacttccgctcgggaaagtggctccaagagcccgccacaggggacgccagggactcgcggcaggctctgcgggccaggatgagttctaagcacaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcacttggtcccctggttacagtcagtcaaagaccatgagcgggaacgggccacggccagcatggctcaagttctgaagtgcctatccaaacatctcaacttgaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtctttgaaggttttcttgattcaaatgagctctgccagtttataatgactacatttgataccctgaaaaccctgaaacatccctgcatccagcgatcagcaggagaattactgctaactttggcaaaaaatacagagtcccaatttgagaaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgcaacagatgccctttatgaggtgtttttgggaaacaggcttcgagcagctacgttccgactctttcctcagcttctcatgacactgcttatccagattcatcacagcatcggcctcaccatgtctgatgtcgacatcccaagtggcctgtacacagaacaggaagtgccttcagaggtcacccctttgtgctttgccatgcaggctacaaagactctcctcctcagaacatgctgcttgcaggaattcaacatcatggaaaagaataaaggatgggctctcctgggaggaaaagatggccatcttcagggactatttctccttgccaacgcattgctggaaagaaatcagctccttgcacagaaggtcatgtacttattagtccctcttcttaaccgagggaatgataaacataaactcacatctgcaggcttttttgtggagcttctccggagtccagtggccaagagactgcccagcatatactctgttgcccgctttaaagactggctacaagatggaaatcatctctttagaattctcggcctgaggggactgtacaatcttgttggacaccaggagatgagagaagacatcaagagcctgttgccatacattgtagacagcttgcgtgaaaccgatgagaagatcgttctgtcagccatccagatactcctgcaacttgttagaacaatggatttcactaccctggctgccatgatgaggaccctgttctccttatttggtgatgtgagatctgatgttcatcgtttctccgtgactctctttggagccgccataaagtctgtaaaaaacccagataagaagagtatagagaaccaagtcctggacagcttggtcccactacttctgtattctcaggatgaaaatgatgcagtagctgaggagagcaggcaagtcctaactatatgtgcccagttcctgaagtggaagctgccccaagaagtgtactccaaagatccctggcacatcaaacctactgaagcaggaacaatctgcagattctttgaaaaaaagtgcaaggggaaaattaacatcctagaacaaacactgatgtactccaagaacccaaaacttcccatcagaagatcagcagtcttgtttgtaggccttttatcgaagtacatggatcacaatgagctcaggaggatgggtactgactggatagaggacgatctgagagacctgctgtgtgaccctgagccctcgctgtgcatcatcgcttcccagactctgttactagtccagatggcgagggccgaaccaaaacctaagcagagagtgaactggttgcagaagctcatgggcaggtcctctgcctagaaacacaaggcaagcaacatcagagacagaatcttgctatgttgtgcggcaagctagtcttgaactcatggcctcaagtcatcctcctgtgtcagcctcccaaagtgctgggattacaagcatgcaccacggcacccagcagaattccagtcttgagaaacaggtcaaggacagcttcaaaagagattctaaataaatgttaatgttacaatgtta

SEQ ID NO: 150554 - DNA, 2088 bp, Homo sapiens
  Payload ID: 9736
  Gene Symbol: MROH8
  Gene Name: maestro heat-like repeat family member 8
  ENST ID: ENST00000400440
  CDS Start-End: 1-1889
accaaccccgccaggtcgcgggcactcccaccagctcgcagccctccttcggaccctcgatccgagagcgccccagccagagcttgtgcccatgcccctgtcccgcaggggaaggggatcccgcctggccggctctcgagcggcgactagtaacctcccgcgggcgacagccctctccccaaagccacgcgcaactcctcacccggcggcgccattcctccgagcaggtcccgccggagtccgagccgcgggctgacttccgctcgggaaagtggctccaagagcccgccacaggggacgccagggactcgcggcaggctctgcgggccaggatgagttctaagcacaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcacttggtcccctggttacagtcagtcaaagaccatgagcgggaacgggccacggccagcatggctcaagttctgaagtgcctatccaaacatctcaacttgaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtctttgaaggttttcttgattcaaatgagctctgccagtttataatgactacatttgataccctgaaaaccctgaaacatccctgcatccagcgatcagcaggagaattactgctaactttggcaaaaaatacagagtcccaatttgagaaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgtaagcccttgagctttgcccctctaatgtcagcccctcccaggatgactgaccccacaccccagtggagagtgttccttttggtccctctcaaagcctgcatctgtcatccatttataagtctacagtgtttctgccaagggattgacatggagggagctggggagagtgaaggagtcagaatgccttaatacaaactcgtccaacctgc

SEQ ID NO: 150555 - DNA, 3345 bp, Homo sapiens
  Payload ID: 9736
  Gene Symbol: MROH8
  Gene Name: maestro heat-like repeat family member 8
  ENST ID: ENST00000400441
  CDS Start-End: 1-2841
atgcccctgtcccgcaggggaaggggatcccgcctggccggctctcgagcggcgactagtaacctcccgcgggcgacagccctctccccaaagcacgcgcaactcctcacccggcggcgccattcctccgagcaggtcccgccggagtccgagccgcgggctgacttccgctcgggaaagtggctccaagagcccgccacaggggacgccagggactcgcggcaggctctgcgggccaggatgagttctaagcacaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcacttggtcccctggttacagtcagtcaaagaccatgagcgggaacgggccacggccagcatggctcaagttctgaagtgcctatccaaacatctcaacttgaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtctttgaaggttttcttgattcaaatgagctctgccagtttataatgactacatttgataccctgaaaaccctgaaacatccctgcatccagcgatcagcaggagaattactgctaactttggcaaaaaatacagagtcccaatttgagaaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgcaacagatgccctttatgaggtgtttttgggaaacaggcttcgagcagctacgttccgactctttcctcagcttctcatgacactgcttatccagattcatcacagcatcggcctcaccatgtctgatgtcgacatcccaagtggcctgtacacagaacaggaagtgccttcagaggtcacccctttgtgctttgccatgcaggctacaaagactctcctcctcagaacatgctgcttgcaggaattcaacatcatggaaaagaataaaggatgggctctcctgggaggaaaagatggccatcttcagggactatttctccttgccaacgcattgctggaaagaaatcagctccttgcacagaaggtcatgtacttattagtccctcttcttaaccgagggaatgataaacataaactcacatctgcaggcttttttgtggagcttctccggagtccagtggccaagagactgcccagcatatactctgttgcccgctttaaagactggctacaagatggaaatcatctctttagaattctcggcctgaggggactgtacaatcttgttggacaccaggagatgagagaagacatcaagagcctgttgccatacattgtagacagcttgcgtgaaaccgatgagaagatcgttctgtcagccatccagatactcctgcaacttgttagaacaatggatttcactaccctggctgccatgatgaggaccctgttctccttatttggtgatgtgagatctgatgttcatcgtttctccgtgactctctttggagccgccataaagtctgtaaaaaacccagataagaagagtatagagaaccaagtcctggacagcttggtcccactacttctgtattctcaggatgaaaatgatgcagtagctgaggagagcaggcaagtcctaactatatgtgcccagttcctgaagtggaagctgccccaagaagtgtactccaaagatccctggcacatcaaacctactgaagcaggaacaatctgcagattctttggaaaaaaagtgcaaggggaaaattaacatcctagaacaaacactgatgtactccaagaacccaaaacttcccatcagaagatcagcagtcttgtttgtaggccttttatcgaagtacatggatcacaatgagctcaggaggatgggtactgactggatagaggacgatctgagagacctgctgtgtgaccctgagccctcgctgtgcatcatcgcttcccagactctgttactagtccagatggcgagggccgaaccaaaacctaagcagagagtgaactggttgcagaagctcatgggcaggtcctctgcctagaaacacaaggcaagcaacatcagagacagaatcttgctatgttgtgcggcaagctagtcttgaactcatggcctcaagtcatcctcctgtgtcagcctcccaaagtgctgggattacaagcatgcaccacggcacccagcagaattccagtcttgagaaacaggtcaaggacagcttcaaaagagattctaaataaatgttaatgttacaatgtt

SEQ ID NO: 150556 - DNA, 531 bp, Homo sapiens
  Payload ID: 9736
  Gene Symbol: MROH8
  Gene Name: maestro heat-like repeat family member 8
  ENST ID: ENST00000434295
  CDS Start-End: 428-531
ccggagtccgagccgcgggctgacttccgctcgggaaagtggctccaagagcccgccacaggggacgccagggactcgcggcaggctctgcgggccaggatgagttctaagcacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaa

SEQ ID NO: 150557 - DNA, 675 bp, Homo sapiens
  Payload ID: 9736
  Gene Symbol: MROH8
  Gene Name: maestro heat-like repeat family member 8
  ENST ID: ENST00000422138
  CDS Start-End: 602-675
gctgcccggcccattttaaaggaacaggaagggtctcgtcgggaggggatagcttagaagggatttttttttcctctttagaaaattgtggcagtttctggccgggcgcagtggctcacgcctgtaatcccagaactttgggaggccgaggcgggcggattacctgaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaaga

SEQ ID NO: 150558 - DNA, 2000 bp, Homo sapiens
  Payload ID: 9736
  Gene Symbol: MROH8
  Gene Name: maestro heat-like repeat family member 8
  Uniprot ID: Q9H579
  ENST ID: ENST00000421643
  CDS Start-End: 1-1801
gcacccctcccccaggcaccaaccccgccaggtcgcgggcactcccaccagctcgcagccctccttcggaccctcgatccgagagcgccccagccagagcttgtgcccatgcccctgtcccgcaggggaaggggatcccgcctggccggctctcgagcggcgactagtaacctcccgcgggcgacagccctctccccaaagccacgcgcaactcctcacccggcggcgccattcctccgagcaggtcccgccggagtccgagccgcgggctgacttccgctcgggaaagtggctccaagagcccgccacaggggacgccagggactcgcggcaggctctgcgggccaggatgagttctaagcacaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtctttgaaggttttcttgattcaaatgagctctgccagtttataatgactacatttgataccctgaaaaccctgaaacatccctgcatccagcgatcagcaggagaattactgctaactttggcaaaaaatacagagtcccaatttgagaaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgtaagcccttgagctttgcccctctaatgtcagcccctcccaggatgactgaccccacaccccagtggagagtgttccttttggtccctctcaaagcctgcatctgtcatccatttataagtctacagtgtttctgccaagggattgacatggagggagctggggagagtgaaggagtcagaatgccttaatacaaactcgtccaacctgc

SEQ ID NO: 150559 - DNA, 2227 bp, Homo sapiens
  Payload ID: 9736
  Gene Symbol: MROH8
  Gene Name: maestro heat-like repeat family member 8
  ENST ID: ENST00000417458
  CDS Start-End: 1-2011
ctgcaacacagagtgtctttacaggcagacgtttcaggcattctctgagatgctccagagtttggtggtaaaagacccacatttggaaaatcttgacaccattattaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgcaacagatgccctttatgaggtgtttttgggaaacaggcttcgagcagctacgttccgactctttcctcagcttctcatgacactgcttatccagattcatcacagcatcggcctcaccatgtctgatgtcgacatcccaagtggcctgtacacagaacaggaagtgccttcagaggtcacccctttgtgctttgccatgcaggctacaaagactctcctcctcagaacatgctgcttgcaggaattcaacatcatggaaaagaataaaggatgggctctcctgggaggaaaagatggccatcttcagggactatttctccttgccaacgcattgctggaaagaaatcagctccttgcacagaaggtcatgtacttattagtccctcttcttaaccgagggaatgataaacataaactcacatctgcaggcttttttgtggagcttctccggagtccagtggccaagagactgcccagcatatactctgttgcccgctttaaagactggctacaagatggaaatcatctctttagaattctcggcctgaggggactgtacaatcttgttggacaccaggagatgagagaagacatcaagagcctgttgccatacattgtagacagcttgcgtgaaaccgatgagaagatcgttctgtcagccatccagatactcctgcaacttgttagaacaatggatttcactaccctggctgccatgatgaggaccctgttctccttatttggtgatgtgagatctgatgttcatcgtttctccgtgactctctttggagccgccataaagtctgtaaaaaacccagataagaagagtatagagaaccaagtcctggacagcttggtcccactacttctgtattctcaggatgaaaatgatgcagtagctgaggagagcaggcaagtcctaactatatgtgcccagttcctgaagtggaagctgccccaagaagtgtactccaaagatccctggcacatcaaacctactgaagcaggaacaatctgcagattctttgaaaaaaagtgcaaggggaaaattaacatcctagaacaaacactgatgtactccaagaacccaaaacttcccatcagaagatcagcagtcttgtttgtaggccttttatcgaagtacatggatcacaatgagctcaggaggatgggtactgactggatagaggacgatctgagagacctgctgtgtgaccctgagccctcgctgtgcatcatcgcttcccagactctgttactagtccagatggcgagggccgaaccaaaacctaagcagagagtgaactggttgcagaagctcatgggcaggtcctctgcctagaaacacaaggcaagcaacatcagagacagaatcttgctatgttgtgcggcaagctagtcttgaactcatggcctcaagtcatcctcctgtgtcagcctcccaaagtgctgggattacaagcatgcaccacggcacccagcagaattccagtcttgagaaacaggtcaaggacagcttcaaaagagattctaaataaatgttaatgttacaatgtta

SEQ ID NO: 150560 - DNA, 2227 bp, Homo sapiens
  Payload ID: 9737
  Gene Symbol: MROH9
  Gene Name: maestro heat-like repeat family member 9
  Uniprot ID: Q5TGP6
  ENST ID: ENST00000367758
  CDS Start-End: 100-1821
aatatactagagtttctcttcactactttgtctcaccgtgattacagagaagttacaaatatcattactagtagaagactttaatacacctctgtcagcatgttgacaaggaatccaaaaacaaagagtagtctccagattctgcaagacagtgtgaaatggcaccacatggcacataaagttaacagcctattggatgcatactcaggcctgttaagtaatgaatccatgatcctggctgtgaactccagctttgtggatcccttactgcagtttgaatctcagttgaagataatagagtcatcctttggaatgctagttgtcatgccaagtcttgacaaagtaaaagaaatggggagcagttatgagtacattgaggacatggagaatttataccacaatattttaaatatatatgagaacattcttacgagcttggtgtctaaagacctctacaaactacagatcttaaaggaaatgctcgtgtggatgagtaaagatagctcatatctgcaagagagaataatggtgatcatcaacaaggtgttaagatttacagtcacaaaagtcagaaaatacataagtgttgatgctccatgtttgggtctcctggcagcagagctgtctcttttgtgttcccatgaagatccctcgattgtaaaacaagcatcattgggaatgtgtcacctcctctacattgcacggtgtcagaacgatattggaacaaataagcctacaaacggtaaaagtcatagcctccagtttccttcttctgatgtagaatttctacccaaggagtttcaacaagacgaaagtaaaatagctcagagagtagggcaaaccttactgcctcccttgctgactgactttgtgcagagtctcctgatgaaactctcttcacctgatgataaaatcgcatctgatgcagcatccatactgatatttactctggaatttcatgccgagaaggtcaccatggtgtctaagatcgtggatgctatttacaggcaactgtgtgataacaattgtatgaaggatgttatgttgcaggttatcactttgttgacatgcacttcacccaagaaggtcatctttcaacttatggactacccagttccagcagacgacactctgatacagatgtggaaggcggcatgttctcaggcgagcgtggcccctcacgtgctgaagacaatcttattgatactgaaaggaaagcctggggaaatggaggacaccgtaacggaagggaaacgtttctctcttgatattaccaacttgatgcctttggcggcatgccaggccctgtgcacctttctgcctcttggttcctacaggaaagcggtggcccagtatttcccccagctcttgacgactcttatgttccaagtcttctacaacagtgagctgaaaccgatactcaaggacagggctttgtatgcccaggatgccctgagagttctgctgaattgttctggactgcaacaggtggatattactctaatgaaggagaatttctgggaccagttatctgaagatctgtgttactatcatggagtctgctttattgctaaaactctcagtgaatataactttccacagtttccggagaccctgagttatctctataagctctcagtagaaggtcctagaaggtcagaagacactgtcatcgtattaatattcctcactgaagtgagttttgtagactgtgaacagctgtgttctcatttccttttcttacccaaatttaaatcaaaattccagtttctcgtatctctccctctgaatgttggttcttaccaagacttaagatcatgaaagatatctgaagtcggatggggagaggtgtggagttagatctgggttatggaagagttgtcccttcagctttccccagcagttggtttttctctgtttctaggggtgtgaatttgtacaaaaactaattattttttaggaccagtttatatatttctgcatgattgttaaagtatattgagggataattgggtttaataaagatggtagttaacatctgggatctaggcagtacttctgaccatctagagggagaaaggaactggctgagtaactgggtaaaatgaagatgtggaaccatattactttgtatatcaatattgtgccatgtattgtaatactataatggaatcaagcaaattgacaaacttttgtttacaaaaaataaaggctttataacctgaaa

SEQ ID NO: 150561 - DNA, 3165 bp, Homo sapiens
  Payload ID: 9737
  Gene Symbol: MROH9
  Gene Name: maestro heat-like repeat family member 9
  Uniprot ID: Q5TGP6
  ENST ID: ENST00000367759
  CDS Start-End: 155-2740
aaagaatttgcttggttgataactacctagagtattttacctttggctaagaggtaatatactagagtttctcttcactactttgtctcaccgtgattacagagaagttacaaatatcattactagtagaagactttaatacacctctgtcagcatgttgacaaggaatccaaaaacaaagagtagtctccagattctgcaagacagtgtgaaatggcaccacatggcacataaagttaacagcctattggatgcatactcaggcctgttaagtaatgaatccatgatcctggctgtgaactccagctttgtggatcccttactgcagtttgaatctcagttgaagataatagagtcatcctttggaatgctagttgtcatgccaagtcttgacaaagtaaaagaaatggggagcagttatgagtacattgaggacatggagaatttataccacaatattttaaatatatatgagaacattcttacgagcttggtgtctaaagacctctacaaactacagatcttaaaggaaatgctcgtgtggatgagtaaagatagctcatatctgcaagagagaataatggtgatcatcaacaaggtgttaagatttacagtcacaaaagtcagaaaatacataagtgttgatgctccatgtttgggtctcctggcagcagagctgtctcttttgtgttcccatgaagatccctcgattgtaaaacaagcatcattgggaatgtgtcacctcctctacattgcacggtgtcagaacgatattggaacaaataagcctacaaacggtaaaagtcatagcctccagtttccttcttctgatgtagaatttctacccaaggagtttcaacaagacgaaagtaaaatagctcagagagtagggcaaaccttactgcctcccttgctgactgactttgtgcagagtctcctgatgaaactctcttcacctgatgataaaatcgcatctgatgcagcatccatactgatatttactctggaatttcatgccgagaaggtcaccatggtgtctaagatcgtggatgctatttacaggcaactgtgtgataacaattgtatgaaggatgttatgttgcaggttatcactttgttgacatgcacttcacccaagaaggtcatctttcaacttatggactacccagttccagcagacgacactctgatacagatgtggaaggcggcatgttctcaggcgagcgtggcccctcacgtgctgaagacaatcttattgatactgaaaggaaagcctggggaaatggaggacaccgtaacggaagggaaacgtttctctcttgatattaccaacttgatgcctttggcggcatgccaggccctgtgcacctttctgcctcttggttcctacaggaaagcggtggcccagtatttcccccagctcttgacgactcttatgttccaagtcttctacaacagtgagctgaaaccgatactcaaggacagggctttgtatgcccaggatgccctgagagttctgctgaattgttctggactgcaacaggtggatattactctaatgaaggagaatttctgggaccagttatctgaagatctgtgttactatcatggagtctgctttattgctaaaactctcagtgaatataactttccacagtttccggagaccctgagttatctctataagctctcagtagaaggtcctagaaggtcagaagacactgtcatcgtattaatattcctcactgaacttctgaataacttcttcaaggaccctttaccagaagaatttttggtcctcttcataaactggatcaatgattccaatcctgtagttagcagactgatccttcatagaattgtccacatgtcaccaattatcaataagacagaaaatgtcagcagtatattaatagccatcctggatgccttcctttccaaagacgataatgttgtacttcaggccttgctcacccttagaaggcttttaaacgaactggacaaagtgacctactctttgggtaccagaattggttccagctactgtactctgatggatcatattaatggaggcattcgaagtatggcaattcgacactttggtcaattagttagggatatgagacagtacacatggatggtgaatgatgtggttctagaaggcttggtgcccctaatcctatttttggaggatgatgataaaagagtagctgaagcatgtaaatatacattaaaaatctgtacctcacaattaaagtggtcaacatcacgtttgctcaaagatgaaaattacagttttgagatggtggtgctcaatatctgtaacaatcttattatttctcataggaactacattacagatttgacatctgataccttacgattcctgtggagccccagaacatatcttaagagggcatcggttattttgataggatatttggcaaaatcaggtggtcatttactgcttagagatgaaatcgaagtcatgcttgatgttattgaacgactgctccgagatgaagaccctatgatcaaacagttggctgaaataacctatgatatttttaagaaaaaagcccataaactgacctctgcacctcttaaacaaaacttccaaaaattgcttaaattattctacatcaaaaaattgaagcctctttacaattataactcacccaatggccagatagacagtcctacagacagtaaagatgtcaagaatgataaggccttatagaagagaatgatgatgacattcatcattcataaacaatgggaagtccaacaatgtcttggagctgaccttagaagaagaatgatttttctttccctcctgacaacttgagtctgtttgtagatgcttttctgaaaaattctggaagcttttactgttacttcttaattctctattcaaatatagaaatctgagagaactagtgcctctgtatgtctgacagtgatcagaagccctatttcatcaaaaccactaagacaattgaaaataacataagcaaagtgtttgatgagaagctctgggaacttgattcagtccggaagctctactgagcaccttctaagtgccagatactgtgttaggcagtggggacatttggatgatatagacaaggttcctgatctcaggatgggcacagtctagtgaca

SEQ ID NO: 150562 - DNA, 687 bp, Homo sapiens
  Payload ID: 9737
  Gene Symbol: MROH9
  Gene Name: maestro heat-like repeat family member 9
  ENST ID: ENST00000426136
  CDS Start-End: 1-562
gatgcctttggcggcatgccaggccctgtgcacctttctgcctcttggttcctacaggaaagcggtggcccagtatttcccccagctcttgacgactcttatgttccaagtcttctacaacagtgagctgaaaccgatactcaaggacagggctttgtatgcccaggatgccctgagagttctgctgaattgttctggactgcaacaggtggatattactctaatgaaggagaatttctgggaccagttatctgaagatctgtgttactatcatggagtctgctttattgctaaaactctcagtgaatataactttccacagtttccggagaccctgagttatctctataagctctcagtagaaggtcctagaaggtcagaagacactgtcatcgtattaatattcctcactgaacttctgaataacttcttcaaggaccctttaccagaagaatttttggtcctcttcataaactggatcaatgattccaatcctgtagttagcagactgatccttcatagaattgtccacatgtcaccaattatcaataaggtcgactgaatttaagcacgttccattttctgtaattctacactccaaagtatcttgcaaaatgctgacagtgcaaatgttctataaatcattacttttataatacatccaataataaatcgttgtttatctaa

SEQ ID NO: 150563 - DNA, 1677 bp, Homo sapiens
  Payload ID: 9738
  Gene Symbol: MAF1
  Gene Name: MAF1 homolog, negative regulator of RNA polymerase III
  Uniprot ID: Q9H063
  ENST ID: ENST00000322428
  CDS Start-End: 405-1175
gttgtccggccgggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgacccagcccagccagacccggcccggcgcggcctgatctaacccagccaggcaggcaatactagcccctctggagcacggagctccttccccaaagacatgaagctattggagaactcgagctttgaagccatcaactcacagctgactgtggagactggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcgggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgactta

SEQ ID NO: 150564 - DNA, 737 bp, Homo sapiens
  Payload ID: 9738
  Gene Symbol: MAF1
  Gene Name: MAF1 homolog, negative regulator of RNA polymerase III
  ENST ID: ENST00000527572
  CDS Start-End: 528-737
gacgtggcccaggcgggcgctgcctggtgactgcagcgccccagcggggccgagggaccgccctcctaggcgtctggagaaactaggcaatttttccgggtagagtggaggaacctgtagttttcctctccccgggccagaaagtagccaaaacgaaagagcgcccgcccaggtgaccgcagggcccggagtcccaggtgtcctggttcctaaccgggatgcagcctcttaccttggctgaggagcccagccagcctgagggagactgcaggagtcacgtcccgttgcggactcaagagttacccccatggtggctggagctcttttggagtgggcgtggagatggggaatgggaatgttgagcaacaatctcagccagcagccccagggtgagcagggtccccggtggtctagtctagtcccagaactcgcgtgttctgcagggggtatggctgacctggagcctggacttaccaccctcaggcaatactagcccctctggagcacggagctccttccccaaagacatgaagctattggagaactcgagctttgaagccatcaactcacagctgactgtggagactggagatgcccacatcattggcaggattgagagctactcatgtaagatggcaggagacgacaaacacatgttcaagcagttctgccaggagggccagccccacgtgctggaggcactttctccaccccagacttcaggactgagccccagc

SEQ ID NO: 150565 - DNA, 1754 bp, Homo sapiens
  Payload ID: 9738
  Gene Symbol: MAF1
  Gene Name: MAF1 homolog, negative regulator of RNA polymerase III
  ENST ID: ENST00000534585
  CDS Start-End: 392-1252
gggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgacccagcccagccagacccggcccggcgcggcctgatctaacccagccaggcaggcaatactagcccctctggagcacggagctccttccccaaagacatgaagctattggagaactcgagctttgaagccatcaactcacagctgactgtggagactggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacaggtgggccggcatccctgcagatggcctccaggcctccaggtttgtggggcacttggcgcctcacaccacctgtcaccctatactccccagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcgggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgactta

SEQ ID NO: 150566 - DNA, 868 bp, Homo sapiens
  Payload ID: 9738
  Gene Symbol: MAF1
  Gene Name: MAF1 homolog, negative regulator of RNA polymerase III
  ENST ID: ENST00000527058
  CDS Start-End: 112-868
tggaggaacctgtagttttcctctccccgggccagaaagtagccaaaacgaaagagcgcccgcccaggcaatactagcccctctggagcacggagctccttccccaaagacatgaagctattggagaactcgagctttgaagccatcaactcacagctgactgtggagactggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacaggtgggccggcatccctgcagatggcctccaggcctccaggtttgtggggcacttggcgcctcacaccacctgtcaccctatactccccagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatgg

SEQ ID NO: 150567 - DNA, 632 bp, Homo sapiens
  Payload ID: 9738
  Gene Symbol: MAF1
  Gene Name: MAF1 homolog, negative regulator of RNA polymerase III
  ENST ID: ENST00000534811
  CDS Start-End: 1-495
ctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcgggggcagtggggccgaggagaccagcaccatggaggaggacaggtgtgtgatgggggccatgacccgggtccttgaagcctggagtgggtacaacagggtgggggcctcctctacttggtctaagtggtggctcctgaaggcccactgtgtgccaacctccgcccagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagct

SEQ ID NO: 150568 - DNA, 1098 bp, Homo sapiens
  Payload ID: 9738
  Gene Symbol: MAF1
  Gene Name: MAF1 homolog, negative regulator of RNA polymerase III
  Uniprot ID: Q9H063
  ENST ID: ENST00000532522
  CDS Start-End: 220-990
cccgacgtggcccaggcgggcgctgcctggtgactgcagcgccccagcggggccgagggaccgccctcctaggcgtctggagaaactaggcaatttttccgggtagagtggaggaacctgtagttttcctctccccgggccagaaagtagccaaaacgaaagagcgcccgcccaggcaatactagcccctctggagcacggagctccttccccaaagacatgaagctattggagaactcgagctttgaagccatcaactcacagctgactgtggagactggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcgggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctg

SEQ ID NO: 150569 - DNA, 2179 bp, Homo sapiens
  Payload ID: 9739
  Gene Symbol:
  Gene Name: MaFF-interacting protein  [Source:UniProtKB/Swiss-Prot
  Acc:Q8WZ33]
  Uniprot ID: Q8WZ33
  ENST ID: ENST00000613230
  CDS Start-End: 1748-2122
gcagccctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccacgcccagcgcgagcgcctggactcggccaacctgtgggtgctggtggactgcatccttcgcgacacctccgaggacctgggactccagtgtgacgccgtgaacctggccttcgggcgccgctgtgaggaactggaggacgcgcggcacaagctgcagcaccacctgcacaaggtggggcaccctgaaccccgaagacggctccggcgcctgcccaccactctgccccctctcatcacctggcctgggccctcaacacctttctcctctgtcccacttatcccgagggaccccagaagcaagtgtcacctctccgtaaacctatgtaaaaccaggtgacactgggtatgatcgcagtgtgttgcaacccccatgactgagaaggaggagctgtggggaggatggaggcaggagctggtctggggagcattgactgcctgggaggtccccaagagtcctggcctggcaggcagggctctgactctagggcctcagcatggcctttaccacctctgagtccccagtccttgagcaggatttgggtcctggtgaccaccaaggatgggggttcttggaccagagctaagagacaacaggctgcctgactctccagagcccgctgggggccccgtgcacattgttcccctcacccacgcctccccagggccactggtcaggaccaccctctggacacagccccaggagctgggtaggaccagactggtctctacattccatatgcccgggcatgggggcacaggcccaaggggcactgtcctgtctgcagatgctgcgggaaatcacagatcaggaacacaacgtggtggcactgaaggaggccatcaaggacaaggaggaacctctgcacatagcccagacccggctgtagctgctctcacaccggcccaacatgcagctgtgccgcgatgcagcccagttcaggtactgcctgggcctctgaggcagtcccaggtgcccccgtccacctcctcgctgcgaccctctccaataaacactccaatctccacacacacatcccccacaggtgctgagaggggagggagactctgcggccacacacaacatgcaagcacgccttaaacacacagatatagacatgacactgggcaggtcatgggtcgggggcctccccgtgccagggacctgtgcccacgtggtctcaccccaccctgtgctacctcatcttcccgggaggaagctccttcagacaaggtgagctcctggaggccacggggccagagaggccagagagggccattccctgctgccctgagggtgctgtccccacctctggtggaaagtatgacctacgcctgggctacaggcatagatgggccgtccttttgtttcccttgttaacggatgcctggtggccccttctgagcctaagtacctttcttccttccctgcccctcagttccttcaaggaactgggtgcctccttccgtcaaatatcaggaatggaaagaactgagcctggtcggctgaggccagtcctgtcctgtcagggtcgagattgcacgcgggtcactcattcccactcaggtccgcgctccctgggaggaccctcgtaatttatgctctgccctagagccgctttcctggtaggatcctttcatggcgtcttcccaggacctcctgccagctcccattgggagttttgggtcccctccaccccagtaggtgcatacttctgccctccccagccccagctcacaccccccaacacccccaagctggtgagtgaggtggaggagctgtacaagtccatcacagcgctgcgggagaagcttctacaagcggagcagtccctgcgcaacctcaaggacatccacatgagcctggagaaggacgtcaccgccatgaccaacagtgtcttcatcgaccgccagaagtgcatggcccatcgtacttgctaccccaccattctgcagctggctggctaccagtgagcagcggcacggtgcttccccccaatcccccaaataaacagtgcgttagctttctgc

SEQ ID NO: 150570 - DNA, 553 bp, Homo sapiens
  Payload ID: 9740
  Gene Symbol: MAGIX
  Gene Name: MAGI family member, X-linked
  ENST ID: ENST00000454342
  CDS Start-End: 124-553
aagattacttgaggggatggtgcgtaaatggtgggccagtttgtatatgagctgcaggggcaagacaagtagatgaggctagaatgttaactcagggaacaggtcctaggtagtttccatggcatgtcccccaacagccctctccactgcttttatctcccagctgttagcgtgctggactctgcggacatagaggtcacagacagtcgcctgcctcatgccactattgtggatcaccggccccaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgatcgcagcccagatcctggagggccggaggtaacggggtctcgcagcagcagcacttccctagttcagcaccctccatcccggacgacgctcaagaagacccggggcagcccggagcctagtccagaggcggccg

SEQ ID NO: 150571 - DNA, 1238 bp, Homo sapiens
  Payload ID: 9740
  Gene Symbol: MAGIX
  Gene Name: MAGI family member, X-linked
  ENST ID: ENST00000595224
  CDS Start-End: 1-1005
atggagccgcgcacaggggacgccgcggaccctagggggagcagaggaggccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggaggctgttagcgtgctggactctgcggacatagaggtcacagacagtcgcctgcctcatgccactattgtggatcaccggccccagcaccgttggttagagacatgtaacgcacctccccaattgatccagggtaaggcacgtagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagctcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccgg

SEQ ID NO: 150572 - DNA, 1057 bp, Homo sapiens
  Payload ID: 9740
  Gene Symbol: MAGIX
  Gene Name: MAGI family member, X-linked
  ENST ID: ENST00000615626
  CDS Start-End: 48-824
aaaattcgtagctggcagccctgcgtccacccggcggactactggccatggagccgcgcacaggggacgccgcggaccctagggggagcagaggaggccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggaggctgttagcgtgctggactctgcggacatagaggtcacagacagtcgcctgcctcatgccactattgtggatcaccggccccaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagctcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccgg

SEQ ID NO: 150573 - DNA, 780 bp, Homo sapiens
  Payload ID: 9740
  Gene Symbol: MAGIX
  Gene Name: MAGI family member, X-linked
  ENST ID: ENST00000614322
  CDS Start-End: 271-393
cgcctgcagcagagtgaggccaagcactcctcctggctcctacagccaggcctccttgctggccgccaggccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggaggctgttagcgtgctggactctgcggacatagaggtcacagacagtcgcctgcctcatgccactattgtggatcaccggccccagggtaaggcacgtagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgatcgcagcccagatcctggagggccggaggtaacggggtctcgcagcagcagcacttccctagttcagcaccctccatcccggacgacgctcaagaagacccggggcagcccggagcctagtccag

SEQ ID NO: 150574 - DNA, 3295 bp, Homo sapiens
  Payload ID: 9740
  Gene Symbol: MAGIX
  Gene Name: MAGI family member, X-linked
  ENST ID: ENST00000616266
  CDS Start-End: 384-1211
attttacatttccaccggaggtataggagttccatttcctccatatcttcagcaacagttggtattgtcaggcttttaaattctaactaggacctttagttaacagagtgcggcgcctgcagcagagtgaggccaagcactcctcctggctcctacagccaggcctccttgctggccgccaggccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggaggctgttagcgtgctggactctgcggacatagaggtcacagacagtcgcctgcctcatgccactattgtggatcaccggccccaggtaccatctcatccttctatcggaggcctcctgcctcagggcaaactatgtacacctgtgtcctttattccagcaccgttggttagagacatgtaacgcacctccccaattgatccagggtaaggcacgtagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagctcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggtcttgacttgccaggcgctcgaggcggggtggggctgcccgggccactctgtaaaggagcaggtgggtcgatcctgcttgagtaatcgctgacgagcttcgtgctgctgctttcctgcttgcacatgttatctttgcttctgccggtcctcagtctggcgtgctttctttttctcttcgccgtctcctgctcctctccttattcattaatttcacctttttggaggtgtacagggtctcacacataaattattgtgcatggcatggagaatgcagaggtgagcctgtcgtggcaggactgcaccagtgtatccacagtcctgtctcggaatcatacagaccctcagctgacgtcgggatagcaaggctagaagcctagaagcagggcagcttccttcgccagaggcctgcggtctcccacttccggcctagtctgccagcttttgctggcacgtaggctaccactctccgggcaccggctggggtcctggagccccctttggggcggagtggggaaggtgtgagtcagcgcccctggacgggccgggctaaaaaaggctgttagaacctttgggccgtgcccccattttccgtacatggtgaagaactgcagccgggcttgtgtgcacacgccacacactgggcgttcccggcacgggagaggcccagagtttccttcaccctgggaacagagccctacagccagggcttatatggccagcgggactccaaccggggtagccgcgaggaaggcgctggcagaggacagaaatgtccagtcacctccgctgtcaccacatcctgagcactcggccccatccccccacaggagggaagctgtggtctgacggaatgggcaactttcgcccctgtggggaggggacggggaaggaagaaagaatttaaaggaccggaatgcgagagtccaggtggccttggagaggaaagaggaacggtgaagacaagctgcgagagctgggagctggagggtgaagaggtgaacacttgagtggttagagctgtagatagacattgtggggaagtgtgccagggtggcttccagctacccctgacttagagcctggtggaggtgtggttcttcagaagtcagcaaagggctcaagagccccagtctataaatacagtcacacccaggagactaataatagtaaccccagccaccatgtacttagttttatccctgctactggctttattgcaatatttattttcatctacaatagttgcacatctactcaactatccgaatatgtccatttcgcagaggaggaaagtgaggcccagggagtgcagatagctacagagaggagggtcaaagcacgatttaatcaaggcctgattcccaagtctgtcctctcaatttcacctgcattgacaagtattaattgaaccccaactgtatatgttgcactgtgctaggtactgtggagatgctggaggaacaagacataaaatttctttgtgtagctgatgtatgtaatgagagtagacagatgtcagacaaaaaagacgagaaaatgaataaataaaaaaccaggccaggcgtggtggctcacgcctgtaatcccagcactttgggaggccgaggctggtggatcacgaggtcaagagttcaagagcagcctggccaagatggtgaaaccccgtctctactgaaaatacaaaaattagccaggtgtggtagcaggtgcctgtaatcacagctactcgggaggctgaggcagagaattgcttgaacccaggaggtggaggttgcagcgagccaagatcgcaccactgcactccagcctgggtgacagagcgagaatcagtctcaaaaaaaaaaaaaaaa

SEQ ID NO: 150575 - DNA, 1757 bp, Homo sapiens
  Payload ID: 9740
  Gene Symbol: MAGIX
  Gene Name: MAGI family member, X-linked
  ENST ID: ENST00000615915
  CDS Start-End: 736-1524
gagtgactggcgcagggcctccgctgggggagggttcggagaggagttgggttcagtgggacaggcctggggggtcagcagctactgccctgtcttgggtggggccaaggggcgcgacttggggcggggatcggagggtgcttcgagtgggaggagccttggggttattctagcatattccttgagggttattgcagtcggcgagggctagattagatgagagtgcggaactggacccccgttctggcggcggtcctttttgaggaggcagggcctggagagtgcttggggggcgggcacgcagcgaaggggcaggcctgaaatgtgagtcacgggggtggagcctatagtcccatgggggcggggcttgagatgtcaggaatgggatgagggttagaggctaattagagggcgtgctatggaaggttcaggagccaaattttggagtagcattctccagggtgggccgaatggtgttgtttgagggatgtgttctgcgtgttattagagggagataggaaggcctggaagattattcacatggctgagcccaggattgtttattaagaaggtggggtcagaacagttaatttgtttgggctgagaacctttaagattacttgaggggatggtgcgtaaatggtgggccagtttgtatatgagctgcaggggcaagacaagtagatgaggctagaatgttaactcagggaacaggtcctaggtagtttccatggcatgtcccccaacagccctctccactgcttttatctcccagctgttagcgtgctggactctgcggacatagaggtcacagacagtcgcctgcctcatgccactattgtggatcaccggccccagggtaaggcacgtagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagctcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccgg

SEQ ID NO: 150576 - DNA, 778 bp, Homo sapiens
  Payload ID: 9740
  Gene Symbol: MAGIX
  Gene Name: MAGI family member, X-linked
  ENST ID: ENST00000614074
  CDS Start-End: 17-778
cggcggactactggccatggagccgcgcacaggggacgccgcggaccctagggggagcagaggaggccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggaggctgttagcgtgctggactctgcggacatagaggtcacagacagtcgcctgcctcatgccactattgtggatcaccggccccaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagctcgctcaggagatggcagccggaaggcggagacactga

SEQ ID NO: 150577 - DNA, 4047 bp, Homo sapiens
  Payload ID: 9741
  Gene Symbol: MAGT1
  Gene Name: magnesium transporter 1
  ENST ID: ENST00000358075
  CDS Start-End: 88-1191
agaaatcaaccttcttttagcgggcgtgtagcgccagcgcgctgtgacgtaatgtgaggggtctcccggcagggctgagctggaccaatgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacggtctcgctgtgtcacacaggctggagtgcagtggcgtgagctcggctgactgcaaactctgcctcccaggtttaagcgattctcctgtcacagcttcccaagtagctgggatttacaggtgtgcaccgccatgccaggctaatttttgtgtttttagtagagacagggtttcgccaagttgtccaggctggtcttgaactcctgggctcaagtgatccgcccgcctcagtctcccaaagtgcgaggatgacatgtgtgagctaccacaccagcaatgtctatgcttctcgatagctgtgaacatgaaaagacatctattgggagtccgaggcaggtggattgcttgaggccaggagttagagaccagcctggccaacaaggcaaaaccccgtctctactaaaaatatgaaaattagctgggcttggtggctcatgcctataatcctagctacttgggaggctgaggcacgagacttgcttaatacctgggaggcggagattgcagtgagccgagatcacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaatctaaa

SEQ ID NO: 150578 - DNA, 962 bp, Homo sapiens
  Payload ID: 9741
  Gene Symbol: MAGT1
  Gene Name: magnesium transporter 1
  Uniprot ID: Q9H0U3
  ENST ID: ENST00000373336
  CDS Start-End: 31-435
gtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgtttcaggttttttgagatggagtctcgctctgttgcccagactagagtgcagtggcttgatctcggctcactgcaacctctgcctcctggattcaagtgattcttctgcctcagcctcctgaatagctggaattacaggtgcccaccaccacgcctggctactttttgtattttgagtacagatggggtttcaccgtattggccaggctggtctcaaactcctgacctcagatgatccacccacctcagcctcccaaagtgctgggattacaggcgtgagccaccacacctggtccatttttagcttcagcatctctactagttctttccccttgcatataaatacttaaggacatagattcaattttgtctttgtttataaatgtgtctaattcatatatttgaacatattttactcaattgtatcaaacataaaaggaaaaagctggatataatgccttgctatacatcttcatatgaatgacttcccaatctaaaaatttattatatcccaaattaaactgttttctcttccactttca

SEQ ID NO: 150579 - DNA, 4019 bp, Homo sapiens
  Payload ID: 9741
  Gene Symbol: MAGT1
  Gene Name: magnesium transporter 1
  ENST ID: ENST00000610432
  CDS Start-End: 63-1166
gtgtagcgccagcgcgctgtgacgtaatgtgaggggtctcccggcagggctgagctggaccaatgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacggtctcgctgtgtcacacaggctggagtgcagtggcgtgagctcggctgactgcaaactctgcctcccaggtttaagcgattctcctgtcacagcttcccaagtagctgggatttacaggtgtgcaccgccatgccaggctaatttttgtgtttttagtagagacagggtttcgccaagttgtccaggctggtcttgaactcctgggctcaagtgatccgcccgcctcagtctcccaaagtgcgaggatgacatgtgtgagctaccacaccagcaatgtctatgcttctcgatagctgtgaacatgaaaagacatctattgggagtccgaggcaggtggattgcttgaggccaggagttagagaccagcctggccaacaaggcaaaaccccgtctctactaaaaatatgaaaattagctgggcttggtggctcatgcctataatcctagctacttgggaggctgaggcacgagacttgcttaatacctgggaggcggagattgcagtgagccgagatcacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaatct

SEQ ID NO: 150580 - DNA, 2788 bp, Homo sapiens
  Payload ID: 9741
  Gene Symbol: MAGT1
  Gene Name: magnesium transporter 1
  Uniprot ID: Q9H0U3
  ENST ID: ENST00000618282
  CDS Start-End: 22-1029
atagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacggtctcgctgtgtcacacaggctggagtgcagtggcgtgagctcggctgactgcaaactctgcctcccaggtttaagcgattctcctgtcacagcttcccaagtagctgggatttacaggtgtgcaccgccatgccaggctaatttttgtgtttttagtagagacagggtttcgccaagttgtccaggctggtcttgaactcctgggctcaagtgatccgcccgcctcagtctcccaaagtgcgaggatgacatgtgtgagctaccacaccagcaatgtctatgcttctcgatagctgtgaacatgaaaagacatctattgggagtccgaggcaggtggattgcttgaggccaggagttagagaccagcctggccaacaaggcaaaaccccgtctctactaaaaatatgaaaattagctgggcttggtggctcatgcctataatcctagctacttgggaggctgaggcacgagacttgcttaatacctgggaggcggagattgcagtgagccgagatcacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctc

SEQ ID NO: 150581 - DNA, 730 bp, Homo sapiens
  Payload ID: 9742
  Gene Symbol: MDP1
  Gene Name: magnesium-dependent phosphatase 1
  Uniprot ID: Q86V88
  ENST ID: ENST00000288087
  CDS Start-End: 113-643
cgccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttggattacactctctggcctttctgggtcgacacgcacgtagaccctccgttccataagagcagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagattttacccaca

SEQ ID NO: 150582 - DNA, 582 bp, Homo sapiens
  Payload ID: 9742
  Gene Symbol: MDP1
  Gene Name: magnesium-dependent phosphatase 1
  Uniprot ID: Q86V88
  ENST ID: ENST00000396833
  CDS Start-End: 111-479
ccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttggattacactctctggcctttctgggtcgacacgcacgtagaccctccgttccataagagcagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagatttta

SEQ ID NO: 150583 - DNA, 2623 bp, Homo sapiens
  Payload ID: 9743
  Gene Symbol: MAGOHB
  Gene Name: mago homolog B, exon junction complex core component
  Uniprot ID: Q96A72
  ENST ID: ENST00000320756
  CDS Start-End: 92-538
gtggtgacgcacttattccgcgcgatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtcatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccatatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatatatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcagggattattcacatttaaatattttcagttataagcagtgaggtcctaaagtgttacaagagtacagtctaccccatgttaggcatatctttgattatgtctttattccttatttcacaatgtatttggtgtgtaggggaggggggagaactaaatgagttttcagctttataaattgttaaacatttagacaaacatatatgtatgtatgaatgtacataaatatttttaactcctattgaccacgagtctcacttcagtttcccagttcctttcaacctctttctgatagatttcctctttcattacttttagtaaccatgttccttgtttccttttattcttccatctgaagccccactcttaaaaagttgcactgttccagtagttataatccacttgccctaggaacaagttagcactgaattttgggtggaataattagtttctgaaggcttgccaggactcctgagcaggtaggctctagagtcgggcagtccaataacttttttgcaataatggaaacgttctatgtgcagtccaatagggtagcaactggccaaatgaggcctactgattacttgaggtgtgccttgtataactgaatttatggtgctatttaaacaatttttttctaacgtgaaaaggataaaacattaaaaactcttgagaactataaagtgaacacctatatgcctacccctacctagattctatacttaacatcttttttactgtaatatctctattataataaatcttggtttttcacttaactggtgtaattggtgccaataaactactttttttgtagtgctatttaattttgattaaatttaggtagccacgtgtctagcggctaccgtttggacagtatagctctagagcatggcttggtaacctgtttgccatggagcactagatggtccttttcactcctcaaaatgcatgcccattgtcttcaggtttgccatggaaagtcaaatgatttccacttcattatgcaagtacgctatcatcttcaggtcttttgtatgtaaaatgtttctgttccagttgtagaccttgatgattgtgcagtatgaaatcgtattgtaattttcttgcatttagatgtcaacctcagaaacaggaacaatcgtcttttgaacttccagtaggcccacagttgttggttgttcctcaaaacaggttgtggctcctgttgaataagatgatccattaaaaactgaacaaggttgaggagaaatagtgcttacgttgaaaaatctttaagtctttgtccccgttctctaacttccttacgttttcgtttatttagctctatccccactatctactagaatttctcatatttaaaccaagatgggagactaggtcattaggaaaatattaccgtctacaattttcttatactttgatctgtcttttatttgattgtaagttgctgatggacagtgatcattagaaactgaattttgtataatactagttttatatgaaactagatttttattgcgctcaggttatgttccttttacctccttccttaataaagagaccacttgaaataatca

SEQ ID NO: 150584 - DNA, 666 bp, Homo sapiens
  Payload ID: 9743
  Gene Symbol: MAGOHB
  Gene Name: mago homolog B, exon junction complex core component
  ENST ID: ENST00000539554
  CDS Start-End: 96-404
actgcaaggcgccgggggacacgttggctgcgttttcggcgggcttcccgggaaagcttagatatgccaacaacagcaattacaaaaatgatgtcatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccatatgggttggacagtccccacacacattaaattctgtaaatgaaagccaccttttgttaaaaatttgctctaataaaacataccaaatcctg

SEQ ID NO: 150585 - DNA, 1057 bp, Homo sapiens
  Payload ID: 9743
  Gene Symbol: MAGOHB
  Gene Name: mago homolog B, exon junction complex core component
  ENST ID: ENST00000544850
  CDS Start-End: 63-335
gtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtcatgatcagaaaagaggcttatgtgcacaagagtgtaatggaagaactgaagagaattattgatgacagtgaaattacaaaagaagatgatgctttgtggcctccccctgatagggttggccgacagaataaatgatgtttctcaggcttctgaagaactctgaaggcctaatttcactctgtaaaaagaaagtttggtttctgaattgggtcttttcaactcttggagaaattccttcaacaacccctggaaggaagaaacatttaatttcacttttgtatatccctgaggattgtactttgtatcaccttctttgaatagaagaaaatgtggagaaatctaacacatgctgacactctgtaggagtaacttaagtcttctgcttaaagaagcattatttagaaaagcaaaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccatatgggttggacagtccccacacacattaaattctgtaaatgaaagccaccttttgttaaaaatttgctctaataaaacataccaaatcctg

SEQ ID NO: 150586 - DNA, 576 bp, Homo sapiens
  Payload ID: 9743
  Gene Symbol: MAGOHB
  Gene Name: mago homolog B, exon junction complex core component
  ENST ID: ENST00000546173
  CDS Start-End: 42-287
acacgttggctgcgttttcggcgggcttcccgggtacaaaaatggctgtggctagcgatttctacctgcgctactacgtagggcacaagggcaagtttgggcacgagtttctggagttcgaatttcggccggacggacgcatgaagagtaccaagcaagaggggagaggtaaagttccacaggagggagtcaggaagatcttcttagaggacggcactcttgagatgagtctcgaaatgagagacttggcctttgagagaaaaaaacagacttccagagcagtatgagcagaggatgaggaaagcttagatatgccaacaacagcaattacaaaaatgatgtcatgatcagaaaagaggcttatgtgcacaagagtgtaatggaagaactgaagagaattattgatgacagtgaaattacaaaagaagatgatgctttgtggcctccccctgatagggttggccgacagaataaatgatgtttctcaggcttctgaagaactctgaaggcctaatttcactctgtaaaaagaaagtttggtttctgaattgggtcttttcaactcttggagaaatt

SEQ ID NO: 150587 - DNA, 705 bp, Homo sapiens
  Payload ID: 9743
  Gene Symbol: MAGOHB
  Gene Name: mago homolog B, exon junction complex core component
  ENST ID: ENST00000540074
  CDS Start-End: 96-230
actgcaaggcgccgggggacacgttggctgcgttttcggcgggcttcccgggaaagcttagatatgccaacaacagcaattacaaaaatgatgtcatgatcagaaaagaggcttatgtgcacaagagtgtaatggaagaactgaagagaattattgatgacagtgaaattacaaaagaagatgatgctttgtggcctccccctgatagggttggccgacagaataaatgatgtttctcaggcttctgaagaactctgaaggcctaatttcactctgtaaaaagaaagtttggtttctgaattgggtcttttcaactcttggagaaattccttcaacaacccctggaaggaagaaacatttaatttcacttttgtatatccctgaggattgtactttgtatcaccttctttgaatagaagaaaatgtggagaaatctaacacatgctgacactctgtaggagtaacttaagtcttctgcttaaagaagcattatttagaaaagcaaaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcag

SEQ ID NO: 150588 - DNA, 868 bp, Homo sapiens
  Payload ID: 9743
  Gene Symbol: MAGOHB
  Gene Name: mago homolog B, exon junction complex core component
  ENST ID: ENST00000545236
  CDS Start-End: 78-323
attccgcgcgatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggacgcatgaagagtaccaagcaagaggggagaggtaaagttccacaggagggagtcaggaagatcttcttagaggacggcactcttgagatgagtctcgaaatgagagacttggcctttgagagaaaaaaacagacttccagagcagtatgagcagaggatgaggtgaaactgctacccaagtagtgtgcaacagtgtgttttctgacagcgctatccttagagaatgttacattgatcttgcctacctgcaacaagaaagttcatttggatatatattttttgggtttttttgaatgcacgttttgtgctggacaacaagcaaatacaaaattttaaggaaagcttagatatgccaacaacagcaattacaaaaatgatgtcatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgt

SEQ ID NO: 150589 - DNA, 841 bp, Homo sapiens
  Payload ID: 9743
  Gene Symbol: MAGOHB
  Gene Name: mago homolog B, exon junction complex core component
  ENST ID: ENST00000543929
  CDS Start-End: 69-314
gatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggacgcatgaagagtaccaagcaagaggggagaggtaaagttccacaggagggagtcaggaagatcttcttagaggacggcactcttgagatgagtctcgaaatgagagacttggcctttgagagaaaaaaacagacttccagagcagtatgagcagaggatgaggtgaaactgctacccaagtagtgtgcaacagtgtgttttctgacagcgctatccttagagaatgttacattgatcttgcctacctgcaacaagaaagttcatttggatatatattttttgggtttttttgaatgcacgttttgtgctggacaacaagcaaatacaaaattttaaggaaagcttagatatgccaacaacagcaattacaaaaatgatgtcatgatcagaaaagaggcttatgtgcacaagagtgtaatggaagaactgaagagaattattgatgacagtgaaattacaaaagaagatgatgctttgtggcctccccctgatagggttggccgacagaataaatgatgtttctcaggcttctgaagaactctgaaggcctaatttcactctgtaaaaagaaagtttggtttctgaattgggtcttttcaactcttggagaaattccttcaacaacccctggaaggaagaaacatttaatttcacttttgtatatccctgaggattgt

SEQ ID NO: 150590 - DNA, 319 bp, Homo sapiens
  Payload ID: 9743
  Gene Symbol: MAGOHB
  Gene Name: mago homolog B, exon junction complex core component
  ENST ID: ENST00000625272
  CDS Start-End: 74-319
cgcgcgatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggacgcatgaagagtaccaagcaagaggggagaggtaaagttccacaggagggagtcaggaagatcttcttagaggacggcactcttgagatgagtctcgaaatgagagacttggcctttgagagaaaaaaacagacttccagagcagtatga

SEQ ID NO: 150591 - DNA, 500 bp, Homo sapiens
  Payload ID: 9744
  Gene Symbol: MAGOH
  Gene Name: mago homolog, exon junction complex core component
  Uniprot ID: P61326
  ENST ID: ENST00000371466
  CDS Start-End: 52-381
ggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggagcttgaaatcgtcattggagatgaacacatttcttttacaacatcaaaaattggttcccttattgatgtcaatcaatccaaggatccagaaggcttacgagtattttattatcttgtccaggacctgaagtgtttggtcttcagtcttattggattacacttcaagattaaaccaatctagactgaatattggtgtggacatggggggtgggtgggagtagaaaattttgtgtatatcagggcagtatttttttatgaactataaatgattgtctttaataaatatgtgataaaatccaa

SEQ ID NO: 150592 - DNA, 756 bp, Homo sapiens
  Payload ID: 9744
  Gene Symbol: MAGOH
  Gene Name: mago homolog, exon junction complex core component
  Uniprot ID: P61326
  ENST ID: ENST00000371470
  CDS Start-End: 163-603
gccacttccgggcgaagaggttagcgagaaggaacccctccacgcagcgacgacgggacctgacgtcacttccgcgcgccgccgcaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaattggttcccttattgatgtcaatcaatccaaggatccagaaggcttacgagtattttattatcttgtccaggacctgaagtgtttggtcttcagtcttattggattacacttcaagattaaaccaatctagactgaatattggtgtggacatggggggtgggtgggagtagaaaattttgtgtatatcagggcagtatttttttatgaactataaatgattgtctttaataaatatgtgataaaatccaatttttattattttataaagacctgaacatgtgaa

SEQ ID NO: 150593 - DNA, 3968 bp, Homo sapiens
  Payload ID: 9745
  Gene Symbol: MGRN1
  Gene Name: mahogunin ring finger 1, E3 ubiquitin protein ligase
  Uniprot ID: O60291
  ENST ID: ENST00000262370
  CDS Start-End: 172-1902
ccgccgtggcgtcggtccccgggccgagccgggggtgggggctcgaggcgcctccgcggccgtggacgagcgtccgtgcggcctggtccgggccatgtccgcgtgaggaccccgccgctgtcgccgctcccgttccggccctggcccctctgcccggcagcgccgcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggtgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctctttttttttttttttgagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttttttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgaggtccgcctcctgggcgagacccagcagtggacagcatggtcctcacacccagctccctgcacacccaggccagccacccctcccgctcgtgcacaggcacgcagatgcgctcacacgtacacacacacaaatgcacgcccacttgcacatgctcacgcacatgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaata

SEQ ID NO: 150594 - DNA, 6425 bp, Homo sapiens
  Payload ID: 9745
  Gene Symbol: MGRN1
  Gene Name: mahogunin ring finger 1, E3 ubiquitin protein ligase
  Uniprot ID: O60291
  ENST ID: ENST00000399577
  CDS Start-End: 94-1752
cggcctggtccgggccatgtccgcgtgaggaccccgccgctgtcgccgctcccgttccggccctggcccctctgcccggcagcgccgcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaagccggtacgtgacctcccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcgtggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatcccccccaagaggcgccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctatgaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccgtgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatctggggacagcgcccggcggcgtcgtgcaggccacagtctgggcattggggctctgtgggaggctcctctctttgccttgcagtagccatccgggggctactctgagcacgggcttgttctcacccagggccgctccccacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggtgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctctttttttttttttttgagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttttttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgaggtccgcctcctgggcgagacccagcagtggacagcatggtcctcacacccagctccctgcacacccaggccagccacccctcccgctcgtgcacaggcacgcagatgcgctcacacgtacacacacacaaatgcacgcccacttgcacatgctcacgcacatgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaa

SEQ ID NO: 150595 - DNA, 6405 bp, Homo sapiens
  Payload ID: 9745
  Gene Symbol: MGRN1
  Gene Name: mahogunin ring finger 1, E3 ubiquitin protein ligase
  Uniprot ID: O60291
  ENST ID: ENST00000415496
  CDS Start-End: 138-1730
gtgggggctcgaggcgcctccgcggccgtggacgagcgtccgtgcggcctggtccgggccatgtccgcgtgaggaccccgccgctgtcgccgctcccgttccggccctggcccctctgcccggcagcgccgcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaagccggtacgtgacctcccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcgtggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatcccccccaagaggcgccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctatgaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccgtgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatctggggacagcgcccggcggcgtcgtgcaggccacagtctgggcattggggctctgtgggaggctcctctctttgccttgcagtagccatccgggggctactctgagcacgggcttgttctcacccagggccgctccccacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggtgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctctttttttttttttttgagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttttttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgaggtccgcctcctgggcgagacccagcagtggacagcatggtcctcacacccagctccctgcacacccaggccagccacccctcccgctcgtgcacaggcacgcagatgcgctcacacgtacacacacacaaatgcacgcccacttgcacatgctcacgcacatgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaata

SEQ ID NO: 150596 - DNA, 1575 bp, Homo sapiens
  Payload ID: 9745
  Gene Symbol: MGRN1
  Gene Name: mahogunin ring finger 1, E3 ubiquitin protein ligase
  ENST ID: ENST00000536343
  CDS Start-End: 120-1082
tccgcggccgtggacgagcgtccgtgcggcctggtccgggccatgtccgcgtgaggaccccgccgctgtcgccgctcccgttccggccctggcccctctgcccggcagcgccgcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctcc

SEQ ID NO: 150597 - DNA, 994 bp, Homo sapiens
  Payload ID: 9745
  Gene Symbol: MGRN1
  Gene Name: mahogunin ring finger 1, E3 ubiquitin protein ligase
  ENST ID: ENST00000590790
  CDS Start-End: 1-994
tttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgcagtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctcc

SEQ ID NO: 150598 - DNA, 498 bp, Homo sapiens
  Payload ID: 9745
  Gene Symbol: MGRN1
  Gene Name: mahogunin ring finger 1, E3 ubiquitin protein ligase
  ENST ID: ENST00000593224
  CDS Start-End: 1-498
gagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcactacctcctgcaggagatctatggcattgagaacaagaacaaccaggagaccaagccctcggacgacgagaacagcgacaacagcaacgagtgtgtggtgtgcctgtccgac

SEQ ID NO: 150599 - DNA, 1841 bp, Homo sapiens
  Payload ID: 9745
  Gene Symbol: MGRN1
  Gene Name: mahogunin ring finger 1, E3 ubiquitin protein ligase
  Uniprot ID: O60291
  ENST ID: ENST00000586183
  CDS Start-End: 1-1593
atgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaagccggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtgg

SEQ ID NO: 150600 - DNA, 1898 bp, Homo sapiens
  Payload ID: 9745
  Gene Symbol: MGRN1
  Gene Name: mahogunin ring finger 1, E3 ubiquitin protein ligase
  ENST ID: ENST00000587747
  CDS Start-End: 116-1898
cggccgtggacgagcgtccgtgcggcctggtccgggccatgtccgcgtgaggaccccgccgctgtcgccgctcccgttccggccctggcccctctgcccggcagcgccgcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagatctcttggaaagtctcacaggcccgcttcattatggcatctgggcccaggacaactggagcagctccacgtggcgggagcggagcacctggccgggcctcgcctcaacccagggaaccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagcc

SEQ ID NO: 150601 - DNA, 556 bp, Homo sapiens
  Payload ID: 9745
  Gene Symbol: MGRN1
  Gene Name: mahogunin ring finger 1, E3 ubiquitin protein ligase
  ENST ID: ENST00000591895
  CDS Start-End: 110-556
gtttacagaccggcacatggcgcttccggttgacgttgctgacagctagtgaggctttagcccgcttcgagcgcccgggggcggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgag

SEQ ID NO: 150602 - DNA, 1665 bp, Homo sapiens
  Payload ID: 9745
  Gene Symbol: MGRN1
  Gene Name: mahogunin ring finger 1, E3 ubiquitin protein ligase
  Uniprot ID: O60291
  ENST ID: ENST00000588994
  CDS Start-End: 1-1665
atgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctga

SEQ ID NO: 150603 - DNA, 1594 bp, Homo sapiens
  Payload ID: 9746
  Gene Symbol: MFSD1
  Gene Name: major facilitator superfamily domain containing 1
  Uniprot ID: Q9H3U5
  ENST ID: ENST00000264266
  CDS Start-End: 63-1460
gctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacc

SEQ ID NO: 150604 - DNA, 2244 bp, Homo sapiens
  Payload ID: 9746
  Gene Symbol: MFSD1
  Gene Name: major facilitator superfamily domain containing 1
  Uniprot ID: Q9H3U5
  ENST ID: ENST00000392813
  CDS Start-End: 81-1508
agtcacccaggaaaagcgaaccgcgccaggccctgtcatcgaccgctgggtccgtcctcccagcgctcgcggccgctcacatgggcgtggccctgcgtgacctgccggggcgtcacgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttgctatttttgctatgataatcctgctgcccttcagactcaagttaaacgaatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagt

SEQ ID NO: 150605 - DNA, 2423 bp, Homo sapiens
  Payload ID: 9746
  Gene Symbol: MFSD1
  Gene Name: major facilitator superfamily domain containing 1
  Uniprot ID: Q9H3U5
  ENST ID: ENST00000415822
  CDS Start-End: 142-1686
agtgcagtaattggtggaaagctggaagtgggcacctcgagggcctcagccccacgaacacagtcacccaggaaaagcgaaccgcgccaggccctgtcatcgaccgctgggtccgtcctcccagcgctcgcggccgctcacatgggcgtggccctgcgtgacctgccggggcgtcacgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagta

SEQ ID NO: 150606 - DNA, 581 bp, Homo sapiens
  Payload ID: 9746
  Gene Symbol: MFSD1
  Gene Name: major facilitator superfamily domain containing 1
  ENST ID: ENST00000477743
  CDS Start-End: 1-581
ggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaatgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatt

SEQ ID NO: 150607 - DNA, 566 bp, Homo sapiens
  Payload ID: 9746
  Gene Symbol: MFSD1
  Gene Name: major facilitator superfamily domain containing 1
  ENST ID: ENST00000486568
  CDS Start-End: 217-566
cggaagttgaagaagtgaagcgccgcgcgcgccgcctgctgcaggagcctgcgcgggaccccagcatcctgaggctgcccagggtcgtcggggtccccggaccccgcgggcgccgccaccggggcgagcaacagcagcagcgcgagcagcggggcggtggggcgcgggcccctgggcccggaccagggagcaggcagccgttgccggcggggctgcatggacgcaggaaagttggctcggcacccgacagacacgggctcggagcgggcagtgccggcgctcgcggaaataaggccgtggtgggcccctcccctccgcccccagggcgaaggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatt

SEQ ID NO: 150608 - DNA, 2121 bp, Homo sapiens
  Payload ID: 9746
  Gene Symbol: MFSD1
  Gene Name: major facilitator superfamily domain containing 1
  Uniprot ID: Q9H3U5
  ENST ID: ENST00000484166
  CDS Start-End: 103-339
cggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgaatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacgga

SEQ ID NO: 150609 - DNA, 639 bp, Homo sapiens
  Payload ID: 9746
  Gene Symbol: MFSD1
  Gene Name: major facilitator superfamily domain containing 1
  ENST ID: ENST00000465739
  CDS Start-End: 530-639
cttgtcaaggctcagccccgtggcctgcactcacctctcctcctgatggccttagcctcctgattgagactgcacactcagaccatgctgttaggactgagggatttttagtcccccaagtaccaatgagagctggagaagtgacaagtggatgtgtccagagaaggaggccgaggcagaccgtgctctctgtttccacagtatcccttctccatttctcccttactgtgatggtctgagttttgtgttccccacaaattaacatatttcagtcctaacactcaaagtgatggattaggaggtagggcctttgaggggtgattagtggctgtatgaaagaggcccgagagtggcacctcatcttttccatcacgcgaggacacagcaaaaaggccctgtgaaccatgaagtgggtcctcaccagaacctgaatctgctggcactttgatcttggatttccagccaccagaaccgcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacg

SEQ ID NO: 150610 - DNA, 384 bp, Homo sapiens
  Payload ID: 9746
  Gene Symbol: MFSD1
  Gene Name: major facilitator superfamily domain containing 1
  ENST ID: ENST00000482835
  CDS Start-End: 1-384
atgttgctagttactccgcgtccggaacgtggaggtcgagggactgagctgggcgagttttgtggcactcctttgctcttcagtaagtcccaggggctagcgactcgccctagaggcgatagatatgaaggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatg

SEQ ID NO: 150611 - DNA, 560 bp, Homo sapiens
  Payload ID: 9746
  Gene Symbol: MFSD1
  Gene Name: major facilitator superfamily domain containing 1
  ENST ID: ENST00000471266
  CDS Start-End: 17-253
gtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgattttattttcttttcatataggatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttg

SEQ ID NO: 150612 - DNA, 2239 bp, Homo sapiens
  Payload ID: 9746
  Gene Symbol: MFSD1
  Gene Name: major facilitator superfamily domain containing 1
  Uniprot ID: Q9H3U5
  ENST ID: ENST00000480292
  CDS Start-End: 97-333
catgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgaatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttcttagacaggatttgtctctgtcacccagactggaatgcagtggagcagtcacagctcaatgtaactttgaactgcggagttcaggtgatcctcccacctcagcctccgtgatagctaagactacagtgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacgga

SEQ ID NO: 150613 - DNA, 592 bp, Homo sapiens
  Payload ID: 9746
  Gene Symbol: MFSD1
  Gene Name: major facilitator superfamily domain containing 1
  ENST ID: ENST00000474670
  CDS Start-End: 108-592
atcgtcatcgtggtcactggtgccacggggcctcagcgcagcttctgtcttaagctcctgggcctccttattttcccctttgcgatcgattccagccacacctgtggatgttgctagttactccgcgtccggaacgtggaggtcgagggactgagctgggcgagttttgtggcactcctttgctcttcagcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacat

SEQ ID NO: 150614 - DNA, 312 bp, Homo sapiens
  Payload ID: 9746
  Gene Symbol: MFSD1
  Gene Name: major facilitator superfamily domain containing 1
  ENST ID: ENST00000491804
  CDS Start-End: 58-312
gggcgcgggcccctgggcccggaccagggagcaggcagccgttgccggcggggctgcatggacgcaggaaagttggctcggcacccgacagacacgggctcggagcgggcagtgccggcgctcgcggaaataaggccgtggtgggcccctcccctccgcccccagggcgaagataattgtgaaacacctgtgccaggccctgggggaatgagggtgaacaatcttaaacatctctgccttcctggagcacaccttctaggcagctatttttgctatgataatcctgctgcccttcagactcaagttaaacga

SEQ ID NO: 150615 - DNA, 2097 bp, Homo sapiens
  Payload ID: 9746
  Gene Symbol: MFSD1
  Gene Name: major facilitator superfamily domain containing 1
  ENST ID: ENST00000471500
  CDS Start-End: 1-195
gaggaggaggatgaggaagcgcgggcgctcctggcaggcggccctgacgaggccgacagaggtgccccggccgcccctggagccctgccggccctctgcgaccccagtcgcctggcgcaccggcttttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacgg

SEQ ID NO: 150616 - DNA, 2361 bp, Homo sapiens
  Payload ID: 9746
  Gene Symbol: MFSD1
  Gene Name: major facilitator superfamily domain containing 1
  Uniprot ID: Q9H3U5
  ENST ID: ENST00000622669
  CDS Start-End: 81-1625
agtcacccaggaaaagcgaaccgcgccaggccctgtcatcgaccgctgggtccgtcctcccagcgctcgcggccgctcacatgggcgtggccctgcgtgacctgccggggcgtcacgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagt

SEQ ID NO: 150617 - DNA, 2173 bp, Homo sapiens
  Payload ID: 9747
  Gene Symbol: MFSD10
  Gene Name: major facilitator superfamily domain containing 10
  Uniprot ID: Q14728
  ENST ID: ENST00000329687
  CDS Start-End: 536-1903
ggacgcacgcgggatggcggagtgggaggcgcgcggggttgggggtgctcctgcgtccggtgtgcaccccatggcccccgccagggagaccgagtccgggccaggggccggaatcgcggggcgcgggccggggctggggttggggttgggatcgggatcgggatcgggatcgggatccgggttccccgcggcttcaagttttctctcgctgttacgagggcgtgggaggcgcggccgtggggtggggtggggccaggtccgcgatgtgctcaccctggtctctcaggaccgttgcctttgcggctattttttgtgcaatccccgaagcctgcgtttcctgctgcctgggttcggggcgggggcatcgcgcaggccagaacggcccctgcgtccgtaggccagagcccctgccatcagcccctttagggtgctcgccggctgtcgggtgtgggggtatgccaggccccggaggactcggcttccccgctaacccgacccgccgcaccccacccaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgtttt

SEQ ID NO: 150618 - DNA, 1753 bp, Homo sapiens
  Payload ID: 9747
  Gene Symbol: MFSD10
  Gene Name: major facilitator superfamily domain containing 10
  Uniprot ID: Q14728
  ENST ID: ENST00000355443
  CDS Start-End: 113-1480
gccgggcgtggccgtcccgcccctggcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttata

SEQ ID NO: 150619 - DNA, 1573 bp, Homo sapiens
  Payload ID: 9747
  Gene Symbol: MFSD10
  Gene Name: major facilitator superfamily domain containing 10
  ENST ID: ENST00000507555
  CDS Start-End: 88-1188
gcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtaggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaacta

SEQ ID NO: 150620 - DNA, 1589 bp, Homo sapiens
  Payload ID: 9747
  Gene Symbol: MFSD10
  Gene Name: major facilitator superfamily domain containing 10
  ENST ID: ENST00000503596
  CDS Start-End: 70-798
tgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatgcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaa

SEQ ID NO: 150621 - DNA, 1639 bp, Homo sapiens
  Payload ID: 9747
  Gene Symbol: MFSD10
  Gene Name: major facilitator superfamily domain containing 10
  ENST ID: ENST00000508221
  CDS Start-End: 69-1139
gttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggctcaccagggcagaagggcacggtcatgggtacactgcgcagcctaggtgctctggccagggccgcggggcccctggtggccgcttcaggtgagggcgcgggatggtgctggggcaggctgggggccaagcacctgccctcgcctcccaagtgccagccccctcggggactgggtgacgccaccgtctctccgcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccag

SEQ ID NO: 150622 - DNA, 1776 bp, Homo sapiens
  Payload ID: 9747
  Gene Symbol: MFSD10
  Gene Name: major facilitator superfamily domain containing 10
  ENST ID: ENST00000514800
  CDS Start-End: 25-1467
caggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcaggtgagggcgcgggatggtgctggggcaggctgggggccaagcacctgccctcgcctcccaagtgccagccccctcggggactgggtgacgccaccgtctctccgcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttataccaa

SEQ ID NO: 150623 - DNA, 1575 bp, Homo sapiens
  Payload ID: 9747
  Gene Symbol: MFSD10
  Gene Name: major facilitator superfamily domain containing 10
  ENST ID: ENST00000507272
  CDS Start-End: 75-377
ggccccggaggactcggcttccccgctaacccgacccgccgcaccccacccaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggagtttctgtgtgcgccactcactggggccacctctgactgcttggggaggcgcccggtgatgctgctgtgcctggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcacc

SEQ ID NO: 150624 - DNA, 2538 bp, Homo sapiens
  Payload ID: 9748
  Gene Symbol: MFSD11
  Gene Name: major facilitator superfamily domain containing 11
  Uniprot ID: O43934
  ENST ID: ENST00000336509
  CDS Start-End: 255-1604
cccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcattttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctggatatggagtatgttttgccatgtaataatgggaagcatatgtcattccccatatgtgttggagaatgacatttaaataaatagcaaagctgggtgtggtgttgcaccgctatactcccagctgttggggaggctgagacagaaggatcacttcagcccaggagattgaggctgcggtgagctatgatcacaccactgcactccaggctgggcaacagagtgagaccctgtcttgaaaataataataggctggtcacagtggctcatgcctgtaatcccaacactttgggaggctgaggtgggtggatcacctgaggtcaggagtttgagaccagcctggccaacatggtgaaacctcatctctactaaaaatacaaaaatgtgttgggtttggtggtgcatgcctgtaatcctagctactagggaggctgaggtaagagaattcgcttgaacctgggaggcggaggttgcagtgagccgagatcgtgccattgcactccagcctggatgacaagagtgaaactccatctcaaaaaaaaaaaaaaaaaaaagaaaagaaaata

SEQ ID NO: 150625 - DNA, 2832 bp, Homo sapiens
  Payload ID: 9748
  Gene Symbol: MFSD11
  Gene Name: major facilitator superfamily domain containing 11
  Uniprot ID: O43934
  ENST ID: ENST00000355954
  CDS Start-End: 737-1930
aaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgcggagcgcttgcgcgtgccaggccacccgggactacgtttcccagcgggccgagcggccggcgccgcggctgcggtcaggtgacccggtcgcctggccgcagtgagtcaggctgggagggcggggccgcgccggctgctgcggctggcacttggccctttaatccccttcgtgggcccctcaacctggagcggataaattcttggcgcttctccgggggttgtgctcttccgtactcggatcgcttcttaggagtatcctaactgccggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcattttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctggatatggagtatgttttgccatgtaataatgggaagcatatgtcattccccatatgtgttggagaatgacatttaaataaatagcaaagctgggtgtggtgttgcaccgctatactcccagctgttggggaggctgagacagaaggatcacttcagcccaggagattgaggctgcggtgagctatgatcacaccactgcactccaggctgggcaacagagtgagaccctgtcttgaaaataataataggctggtcacagtggctcatgcctgtaatcccaacactttgggaggctgaggtgggtggatcacctgaggtcaggagtttgagaccagcctggccaacatggtgaaacctcatctctactaaaaatacaaaaatgtgttgggtttggtggtgcatgcctgtaatcctagctactagggaggctgaggtaagagaattcgcttgaacctgggaggcggaggttgcagtgagccgagatcgtgccattgcactccagcctggatgacaagagtgaaactccatctc

SEQ ID NO: 150626 - DNA, 3612 bp, Homo sapiens
  Payload ID: 9748
  Gene Symbol: MFSD11
  Gene Name: major facilitator superfamily domain containing 11
  Uniprot ID: O43934
  ENST ID: ENST00000588460
  CDS Start-End: 2043-3392
cttggacttggaccttcgtgcggatctggacttggaggtcgaccgagatcgagaacgagtgcgggaccgagacttcgagcggctgtagcgagatcggctgcgagacctggaacgactccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcggtcccgcgggatgtacacgtcgccgacgcgcccgtacttctcgaagacgcgcctcagcgtgtcgggcgaggtgcggtaggtcaggttgtccaccttgagggaggtcataccctccacatcgggaggggggcggccgtagctcatagctctgagtggcggcccggagccccgcgaactggcgccggcttcctcagctctgggcggtgcgacgccgcgcctctcaggcagttgccttccgcgtggggacactgggaaaggccttgccgcagaacagcacggacgggctccgcaggctagcgcacctgagtaacaactgggcgggcagccggcctctgcgcccgtttatatcgctcctcacaaaatggcgcccgcgccacccggaaatgaaaccttctgattggcccaccgcgccccgcttcgtaacgaccctgccgcgcgccccgcccctacccgaagcgcctgcgcacagcccggcgggcgggccaaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgcggagcgcttgcgcgtgccaggccacccgggactacgtttcccagcgggccgagcggccggcgccgcggctgcggtcaggtgacccggtcgcctggccgcagtgagtcaggctgggagggcggggccgcgccggctgctgcggctggcacttggccctttaatccccttcgtgggcccctcaacctggagcggataaattcttggcgcttctccgggggttgtgctcttccgtactcggatcgcttcttaggagtatcctaactgccggtggggagaacttcgccctaaacctggggttccgatccaggaactggaagttgacagcttggctgcctggctcctgcatctgccttctccactcaccatctcatttctttctccaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcattttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaa

SEQ ID NO: 150627 - DNA, 577 bp, Homo sapiens
  Payload ID: 9748
  Gene Symbol: MFSD11
  Gene Name: major facilitator superfamily domain containing 11
  ENST ID: ENST00000586689
  CDS Start-End: 392-577
ccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgcggagcgcttgcgcgtgccaggccacccgggactacgtttcccagcgggccgagcggccggcgccgcggctgcggtcaggtgacccggtcgcctggccgcagattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttca

SEQ ID NO: 150628 - DNA, 757 bp, Homo sapiens
  Payload ID: 9748
  Gene Symbol: MFSD11
  Gene Name: major facilitator superfamily domain containing 11
  ENST ID: ENST00000588031
  CDS Start-End: 142-486
ttcttggcgcttctccgggggttgtgctcttccgtactcggatcgcttcttaggagtatcctaactgccggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacga

SEQ ID NO: 150629 - DNA, 536 bp, Homo sapiens
  Payload ID: 9748
  Gene Symbol: MFSD11
  Gene Name: major facilitator superfamily domain containing 11
  ENST ID: ENST00000585584
  CDS Start-End: 1-354
caaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgaacactgggttttttacaaattgaaggcttgtggcaaccctgcatcgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttct

SEQ ID NO: 150630 - DNA, 2952 bp, Homo sapiens
  Payload ID: 9748
  Gene Symbol: MFSD11
  Gene Name: major facilitator superfamily domain containing 11
  Uniprot ID: O43934
  ENST ID: ENST00000586622
  CDS Start-End: 1138-2487
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacgactccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcggtcccgcgggatgtacacgtcgccgacgcgcccgtacttctcgaagacgcgcctcagcgtgtcgggcgaggtgcggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcattttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctggatatggagtatgttttgccatgtaataatgggaagcatatgtcattccccatatgtgttggagaatgacatttaaataaatagcaaagctggg

SEQ ID NO: 150631 - DNA, 1922 bp, Homo sapiens
  Payload ID: 9748
  Gene Symbol: MFSD11
  Gene Name: major facilitator superfamily domain containing 11
  Uniprot ID: O43934
  ENST ID: ENST00000593181
  CDS Start-End: 354-1547
gtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgcggagcgcttgcgcgtgccaggccacccgggactacgtttcccagcgggccgagcggccggcgccgcggctgcggtcaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcattttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctggata

SEQ ID NO: 150632 - DNA, 446 bp, Homo sapiens
  Payload ID: 9748
  Gene Symbol: MFSD11
  Gene Name: major facilitator superfamily domain containing 11
  ENST ID: ENST00000591864
  CDS Start-End: 311-436
cggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcggtcccgcgggatgtacacgtcgccgacgcgcccgtacttctcgaagacgcgcctcagcgtgtcgggcgaggtgcggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcggtgagttggaatctgtcctccctcctttgaagtgcccatc

SEQ ID NO: 150633 - DNA, 1141 bp, Homo sapiens
  Payload ID: 9748
  Gene Symbol: MFSD11
  Gene Name: major facilitator superfamily domain containing 11
  ENST ID: ENST00000590393
  CDS Start-End: 967-1092
gcgccacccggaaatgaaaccttctgattggcccaccgcgccccgcttcgtaacgaccctgccgcgcgccccgcccctacccgaagcgcctgcgcacagcccggcgggcgggccaaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgcggagcgcttgcgcgtgccaggccacccgggactacgtttcccagcgggccgagcggccggcgccgcggctgcggtcaggtgacccggtcgcctggccgcagtgagtcaggctgggagggcggggccgcgccggctgctgcggctggcacttggccctttaatccccttcgtgggcccctcaacctggagcggataaattcttggcgcttctccgggggttgtgctcttccgtactcggatcgcttcttaggagtatcctaactgccggtggggagaacttcgccctaaacctggggttccgatccaggaactggaagttgacagcttggctgcctggctcctgcatctgccttctccactcaccatctcatttctttctccaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcggtgagttggaatctgtcctccctcctttgaagtgcccatcataatgcagtccagaaatgaaaataaacgttcattatat

SEQ ID NO: 150634 - DNA, 834 bp, Homo sapiens
  Payload ID: 9748
  Gene Symbol: MFSD11
  Gene Name: major facilitator superfamily domain containing 11
  ENST ID: ENST00000588670
  CDS Start-End: 70-405
ttgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcctctgttttcattggaattgctgctgctgtgctttggacagcacaaggaaactgcctgacaatcaattcggatgagcacagcattgggagaaacagtgggattttctgggcacttctgcagtctagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcattttcatcggcattggagaaattttag

SEQ ID NO: 150635 - DNA, 1891 bp, Homo sapiens
  Payload ID: 9748
  Gene Symbol: MFSD11
  Gene Name: major facilitator superfamily domain containing 11
  Uniprot ID: O43934
  ENST ID: ENST00000590514
  CDS Start-End: 167-1516
ggcccctcaacctggagcggataaattcttggcgcttctccgggggttgtgctcttccgtactcggatcgcttcttaggagtatcctaactgccggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcattttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctggata

SEQ ID NO: 150636 - DNA, 857 bp, Homo sapiens
  Payload ID: 9748
  Gene Symbol: MFSD11
  Gene Name: major facilitator superfamily domain containing 11
  ENST ID: ENST00000585865
  CDS Start-End: 1-634
tgcttatacaggtctggaattaactttcttctctggtgtatatggaacctgtattggtgctacaaataaatttggagcagaagagaaaagccttattggactttctggcattttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtttctgtgggtcgggaatctgcgcatggctgagctgagtcctgagcgtctctccaggctgcagtccatgtctctgcaggctgcagtgaaggtgtgttccaggcttcactgggggagggcctgcttccctgctcactcgtatagttgttgcaggagtcagttcctcacagactgtcaggctaagtaaggatcttggtttcttatggctattggctaaagatcgccctctgcccttcatcatgctacggagtagtcctcagggcagcctacgacatggcagctgtctccatcaaaggtcacaagcaaggacagctggagagaacgagagcaagacaaaagccgcagtctctcataacttcatcactgttgcactctgtctgttaggtgccagtcactagttccagcctatt

SEQ ID NO: 150637 - DNA, 843 bp, Homo sapiens
  Payload ID: 9748
  Gene Symbol: MFSD11
  Gene Name: major facilitator superfamily domain containing 11
  ENST ID: ENST00000588768
  CDS Start-End: 1-387
tttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcattttcatcggcattggagaaattttaggtggaagcctcttcggcctgctgagcaagaacaatcgttttggtagaaatccagttgtgctgttgggcatcctggtgcacttcat

SEQ ID NO: 150638 - DNA, 898 bp, Homo sapiens
  Payload ID: 9748
  Gene Symbol: MFSD11
  Gene Name: major facilitator superfamily domain containing 11
  ENST ID: ENST00000587661
  CDS Start-End: 559-898
ccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgcggagcgcttgcgcgtgccaggccacccgggactacgtttcccagcgggccgagcggccggcgccgcggctgcggtcaggtgacccggtcgcctggccgcagtgagtcaggctgggagggcggggccgcgccggctgctgcggctggcacttggccctttaatccccttcgtgggcccctcaacctggagcggataaattcttggcgcttctccgggggttgtgctcttccgtactcggatcgcttcttaggagtatcctaactgccggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctg

SEQ ID NO: 150639 - DNA, 2850 bp, Homo sapiens
  Payload ID: 9748
  Gene Symbol: MFSD11
  Gene Name: major facilitator superfamily domain containing 11
  Uniprot ID: O43934
  ENST ID: ENST00000621483
  CDS Start-End: 599-1948
cgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcggtcccgcgggatgtacacgtcgccgacgcgcccgtacttctcgaagacgcgcctcagcgtgtcgggcgaggtgcggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcattttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctggatatggagtatgttttgccatgtaataatgggaagcatatgtcattccccatatgtgttggagaatgacatttaaataaatagcaaagctgggtgtggtgttgcaccgctatactcccagctgttggggaggctgagacagaaggatcacttcagcccaggagattgaggctgcggtgagctatgatcacaccactgcactccaggctgggcaacagagtgagaccctgtcttgaaaataataataggctggtcacagtggctcatgcctgtaatcccaacactttgggaggctgaggtgggtggatcacctgaggtcaggagtttgagaccagcctggccaacatggtgaaacctcatctctactaaaaatacaaaaatgtgttgggtttggtggtgcatgcctgtaatcctagctactagggaggctgaggtaagagaattcgcttgaacctgggaggcggaggttgcagtgagccgagatcgtgccattgcactccagcctggatgacaagagtgaaactccatctc

SEQ ID NO: 150640 - DNA, 2124 bp, Homo sapiens
  Payload ID: 9749
  Gene Symbol: MFSD12
  Gene Name: major facilitator superfamily domain containing 12
  Uniprot ID: Q6NUT3
  ENST ID: ENST00000355415
  CDS Start-End: 171-1613
tggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcgggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggca

SEQ ID NO: 150641 - DNA, 2039 bp, Homo sapiens
  Payload ID: 9749
  Gene Symbol: MFSD12
  Gene Name: major facilitator superfamily domain containing 12
  Uniprot ID: Q6NUT3
  ENST ID: ENST00000389395
  CDS Start-End: 161-1576
gcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcgggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctggaggagacagccacggggtggtgggctgggcctggaccccaccgtggtgggcagcagggctgcccggcaggcttggtggactctgctggcagcaaataaagagatgacggc

SEQ ID NO: 150642 - DNA, 1014 bp, Homo sapiens
  Payload ID: 9749
  Gene Symbol: MFSD12
  Gene Name: major facilitator superfamily domain containing 12
  ENST ID: ENST00000398558
  CDS Start-End: 1-527
tgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctcttttcttgcctggagaagagggaggggagaggacaagggccctggctactcctggattcctacagtccttgtccagcctccaagacccacaagtcccttcctctgggaagcccccctggcctggaggtgcaccaggaagaagtggtctggggctggcactaagccatggcccagggaagactgggggacccactaggccaggatgagacctgcacgcagtggctcacagcagcacgatttgtgacagcccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtattttaccacaataaacaaaacaaaacaaaaccaaa

SEQ ID NO: 150643 - DNA, 777 bp, Homo sapiens
  Payload ID: 9749
  Gene Symbol: MFSD12
  Gene Name: major facilitator superfamily domain containing 12
  ENST ID: ENST00000589995
  CDS Start-End: 1-777
ctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctg

SEQ ID NO: 150644 - DNA, 1002 bp, Homo sapiens
  Payload ID: 9749
  Gene Symbol: MFSD12
  Gene Name: major facilitator superfamily domain containing 12
  ENST ID: ENST00000585814
  CDS Start-End: 268-483
ggctggggcgggagcccggggcctcccccagctcagcgcagggactctcacctcctcctcgtgggaccccttctcgcccgcgcgtggaccctcgccgcgctcttgcttgacagtcaccacgaagcccccatgctggcccggagccttgccgcccgccggcctggagccaaggataccgcggtcagccccgtcccaagaatctcccctcccccaaaagcccaccccagggcgttttgacccccgacggcggggctgcagcgagagtgcatgagcccgaggaggcagggtctgatggggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaa

SEQ ID NO: 150645 - DNA, 486 bp, Homo sapiens
  Payload ID: 9749
  Gene Symbol: MFSD12
  Gene Name: major facilitator superfamily domain containing 12
  ENST ID: ENST00000592652
  CDS Start-End: 46-486
cccagggcgttttgacccccgacggcggggctgcagcgagagtgcatgagcccgaggaggcagggtctgatggggctggagtgtagtcatcggatctcagctcactgcaacctcgaactcctgggctcaagtgattctcctgcttcagcctctcgagcagttgggaccacagaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcag

SEQ ID NO: 150646 - DNA, 2040 bp, Homo sapiens
  Payload ID: 9749
  Gene Symbol: MFSD12
  Gene Name: major facilitator superfamily domain containing 12
  Uniprot ID: Q6NUT3
  ENST ID: ENST00000588918
  CDS Start-End: 161-1576
gcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcgggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggagacagccacggggtggtgggctgggcctggaccccaccgtggtgggcagcagggctgcccggcaggcttggtggactctgctggcagcaaataaagagatgacggca

SEQ ID NO: 150647 - DNA, 590 bp, Homo sapiens
  Payload ID: 9749
  Gene Symbol: MFSD12
  Gene Name: major facilitator superfamily domain containing 12
  ENST ID: ENST00000589063
  CDS Start-End: 1-543
ctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgtgagtcctggcccacccctccctccccagacactgacccacactctctaatgccatttccacccctcccttgcaggggaccgtgatgcccggccctgactcctgacagcctcctgcacctgtgcaagggaac

SEQ ID NO: 150648 - DNA, 525 bp, Homo sapiens
  Payload ID: 9749
  Gene Symbol: MFSD12
  Gene Name: major facilitator superfamily domain containing 12
  ENST ID: ENST00000588626
  CDS Start-End: 31-192
cccccgacggcggggctgcagcgagagtgcatgagcccgaggaggcagggtctgatgggggcccggagttccgcggctgttttcacctccaaagaaactttcccggacctcccgactgcgcgacgctccaaccaaccgcccgcagcccgcccccgtcggccgccccgcccctccccgcccccggcatgctaatgaaggcctcggcgaacggtcccattgggctggagtgtagtcatcggatctcagctcactgcaacctcgaactcctgggctcaagtgattctcctgcttcagcctctcgagcagttgggaccacaggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcac

SEQ ID NO: 150649 - DNA, 986 bp, Homo sapiens
  Payload ID: 9749
  Gene Symbol: MFSD12
  Gene Name: major facilitator superfamily domain containing 12
  ENST ID: ENST00000615073
  CDS Start-End: 1-492
aagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgatgagacctgcacgcagtggctcacagcagcacgatttgtgacagcccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtattttaccacaataaacaaaacaaaacaaaaccaaaccaaacccaacaaa

SEQ ID NO: 150650 - DNA, 688 bp, Homo sapiens
  Payload ID: 9749
  Gene Symbol: MFSD12
  Gene Name: major facilitator superfamily domain containing 12
  ENST ID: ENST00000615613
  CDS Start-End: 253-684
gggctcaagtgatcctcctgtcttagccttccaaagtgctgggattacaggtgtgggccaccatgcccagccaccatcttggtttaatttctttccttggaaatggagcaaagggctttcactcttctttttcatggctgcatagtattccataattgtttaaacaattgataatagacactgtatcggggtgactggtatacccccaaaatcacatctgcccagagcctcaggacatggccttgtttggaaatggttttagcagatgcagctaagatgaggtcaccccgtgttaggatggccccgaatccagtgcctggcacccttataaggagagggaaacttggacgcagacaggaaggccgggtgaagacagaagcagagaccgggggccaaggagtgcctggggttgcccagagccaccacgggctgcaagaggtgtgggacagactctctcagccacagaagggcccagccccgcacaggcctggatttcagagggcgaacatttctgtggccgaagctcccagtgcgtttgcagtccttggagacggccgcagacacatttgttcttggcctgtctccaggtctgtagcccccacagtgagcggccactggccggaggggaacaggaagagctggaggggacgtcacacacatgagccttttaggaataacgagtgacacg

SEQ ID NO: 150651 - DNA, 2173 bp, Homo sapiens
  Payload ID: 9750
  Gene Symbol: MFSD2A
  Gene Name: major facilitator superfamily domain containing 2A
  Uniprot ID: Q8NA29
  ENST ID: ENST00000372809
  CDS Start-End: 144-1775
gcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcagaaggatgaggaagttgtcttttgcttctcctcattccaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaacctttttttttacagagcctaattaataacttaatgactgtgtacatagcaatgtgtgtgtatgtatatgtctgtgagctattaatgttattaattttcataaaagctggaaagcagctgcctgtt

SEQ ID NO: 150652 - DNA, 2154 bp, Homo sapiens
  Payload ID: 9750
  Gene Symbol: MFSD2A
  Gene Name: major facilitator superfamily domain containing 2A
  Uniprot ID: Q8NA29
  ENST ID: ENST00000372811
  CDS Start-End: 164-1756
gagggggcgtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaacctttttttttacagagcctaattaataacttaatgactgtgtacatagcaatgtgtgtgtatgtatatgtctgtgagctattaatgttattaattttcataaaagctggaaagcagctgcctgtt

SEQ ID NO: 150653 - DNA, 1914 bp, Homo sapiens
  Payload ID: 9750
  Gene Symbol: MFSD2A
  Gene Name: major facilitator superfamily domain containing 2A
  ENST ID: ENST00000420632
  CDS Start-End: 390-1514
agaactataagaggcgcggagggggcgtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaaggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaacctttttttttacagagcctaattaataacttaatgactgtgtacatagcaatgtgtgtgtatgtatatgtctgtgagctattaatgttattaattttcataaaagctggaaagcagctgcctgtttc

SEQ ID NO: 150654 - DNA, 946 bp, Homo sapiens
  Payload ID: 9750
  Gene Symbol: MFSD2A
  Gene Name: major facilitator superfamily domain containing 2A
  ENST ID: ENST00000434861
  CDS Start-End: 148-946
gagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagag

SEQ ID NO: 150655 - DNA, 2834 bp, Homo sapiens
  Payload ID: 9751
  Gene Symbol: MFSD2B
  Gene Name: major facilitator superfamily domain containing 2B
  ENST ID: ENST00000338315
  CDS Start-End: 1-1515
atggcggcgccccctgcaccagccgccaaggggtccccgcagccggagccgcacgccccagagcccggcccggggagcgccaagcgagggcgagaggacagcagagccggtcgcctctcattctgtacaaaggtgtgctatggcattggtggggtccccaaccagatagcctccagcgccacagccttttacctgcagcttttcctgcttgatatagcacagatccctgccgcccaggtgtcacttgttctgtttgggggaaaagtgtctggggcggctgctgaccctgtggctgggttcttcatcaacaggagccagaggacagggtctggacggctcatgccttgggtgctgggctgcacccccttcatcgccctggcctacttcttcctgtggttcctgccccccttcaccagcctgcgaggcctctggtacacgactttctactgcctgttccaggccctggccacgttcttccaggtgccctacacagcgctcaccatgctgctgactccctgcccaagggagcgggactcggccaccgcctaccggatgactgtggagatggcgggaacactgatgggggccactgtccacgggctcatcgtgtccggcgcccacagaccccacaggtgcgaggccactgcgaccccggggccagtcactgtctccccgaatgcagcccatctctactgcattgcggctgccgtggttgtagtgacttaccccgtgtgcatcagtttactgtgcctaggggtgaaggagcggccagacccctctgccccagcctcaggcccaggcttgagtttcctggctgggctgagcctcactacccggcacccaccctacctgaagctggtgatctccttcctgttcatctctgctgctgttcaggtggagcagagctacctggtcctgttctgtacacatgcctcccagctacacgaccacgtccagggcctggtactaactgtcctggtctcagccgtgctgagcaccccgctgtgggagtgggttctccagcgctttgggaagaagacgtcagcctttgggatctttgcgatggtgccctttgcgatcttgctggctgctgtgcccacagcacctgtggcatatgtcgtggcctttgtatctggcgtgagcattgctgtgtccttgctgctaccctggtccatgctgccagacgtggtggatgactttcagctgcagcaccgtcacgggccaggcctggagaccatcttctactcctcctacgtcttcttcaccaagctgtctggcgcatgtgccctgggcatctccaccctcagtctggagttctcggggtataaggcaggggtctgcaagcaagcagaggaggtggtggtcaccctcaaagtcctcattggcgccgtgcccacctgcatgatccttgctgggctctgcatcctcatggtcggctccactccaaagacacccagtcgggacgcctccagccggctgagccttcggaggaggaccagctacagcctggcctaaagcttaggagggcgactgtgaatggacacaggagccagcaccctcggggcctgacatcgccctcctcagccctccagcacctggtctggcagtttagtatgtgacctttctccctgggatgtggagtcttcggcaacgtgtcctgaagggactggcccgcactccaggaccccacttggcatttcttgtctgttgccttcagactatctcagataggcctgtgcccctgactagcccagtagcacttgtctctagaaaaaggaagctcctgcccaacctggcttgtggaccagtaatatctgtggcctaccacccattcaagaaaacgttacagccggctcactgcaaaatccgcctcccgggttcacgccattctcctgcctcagcctcccgagtagctgggactacaggtgcccgccaccacgcccagctaatttttgtatttttagtagagacggggtttcaccgtgttagccagaatggtttcgatctcctgacctcgtgatccgccccgcctcagcctcccaaaggcatgagccaccgtactcggcctgcccaggctggtcttaaactcctggcctcaggtgatcctactgcctcagcctcctgagtagctgggattacagacacagcccccgttcccagctctagcatttcttaaggacaaaattggtgtgtaagtaacaggaaattcacattatgctgtactcattctctaatatcacagccatgttagaacaaatttgggttttcaaaacaagcgtaactgaacagagtatatatatgtatgtatataaatatatagaaatcctaaatggtccctgtgacataagaaatacacatttggtctctgccccaggttcctggcacagagcttctaaaatgctagtaacttcctgagtggtaggggtgaggggaacatcttttgttatacataagaagcccttttcaaacagatctgagtttatgctaatgatgtgactggcagaggatgggggctggttgccagagaaaccaaccatgtgattagaaggttgaaactttcagccttatcttcctaccgggaggggacaggggctgaagactgagctcatcatcaatgatttaatcaattgtgcccatgtaatggagcctccacttccaaacgaagggtttcagagagcttctaggttggtgaacacatccatgtaccaggaggtctaccccactccacggggacagaaactcttgtgtaggggacccttttagatttcattctatatacctcttcagctggctgttcattttataatcaaccaataaatgttaagtaaagtgtt

SEQ ID NO: 150656 - DNA, 1528 bp, Homo sapiens
  Payload ID: 9751
  Gene Symbol: MFSD2B
  Gene Name: major facilitator superfamily domain containing 2B
  Uniprot ID: A6NFX1
  ENST ID: ENST00000406420
  CDS Start-End: 17-1510
cggcgctgcggtggcaatggcggcgccccctgcaccagccgccaaggggtccccgcagccggagccgcacgccccagagcccggcccggggagcgccaagcgagggcgagaggacagcagagccggtcgcctctcattctgtacaaaggtgtgctatggcattggtggggtccccaaccagatagcctccagcgccacagccttttacctgcagcttttcctgcttgatatagcacagatccctgccgcccaggtgtcacttgttctgtttgggggaaaagtgtctggggcggctgctgaccctgtggctgggttcttcatcaacaggagccagaggacagggtctggacggctcatgccttgggtgctgggctgcacccccttcatcgccctggcctacttcttcctgtggttcctgccccccttcaccagcctgcgaggcctctggtacacgactttctactgcctgttccaggccctggccacgttcttccaggtgccctacacagcgctcaccatgctgctgactccctgcccaagggagcgggactcggccaccgcctaccggatgactgtggagatggcgggaacactgatgggggccactgtccacgggctcatcgtgtccggcgcccacagaccccacaggtgcgaggccactgcgaccccggggccagtcactgtctccccgaatgcagcccatctctactgcattgcggctgccgtggttgtagtgacttaccccgtgtgcatcagtttactgtgcctaggggtgaaggagcggccagacccctctgccccagcctcaggcccaggcttgagtttcctggctgggctgagcctcactacccggcacccaccctacctgaagctggtgatctccttcctgttcatctctgctgctgttcaggtggagcagagctacctggtcctgttctgtacacatgcctcccagctacacgaccacgtccagggcctggtactaactgtcctggtctcagccgtgctgagcaccccgctgtgggagtgggttctccagcgctttgggaagaagacgtcagcctttgggatctttgcgatggtgccctttgcgatcttgctggctgctgtgcccacagcacctgtggcatatgtcgtggcctttgtatctggcgtgagcattgctgtgtccttgctgctaccctggtccatgctgccagacgtggtggatgactttcagctgcagcaccgtcacgggccaggcctggagaccatcttctactcctcctacgtcttcttcaccaagctgtctggcgcatgtgccctgggcatctccaccctcagtctggagttctcggggtataaggcaggggtctgcaagcaagcagaggaggtggtggtcaccctcaaagtcctcattggcgccgtgcccacctgcatgatccttgctgggctctgcatcctcatggtcggctccactccaaagacacccagtcgggacgcctccagccggctgagccttcggaggtaagccccgcacgccccctgc

SEQ ID NO: 150657 - DNA, 674 bp, Homo sapiens
  Payload ID: 9751
  Gene Symbol: MFSD2B
  Gene Name: major facilitator superfamily domain containing 2B
  ENST ID: ENST00000453731
  CDS Start-End: 1-135
aaagtcctcattggcgccgtgcccacctgcatgatccttgctgggctctgcatcctcatggtcggctccactccaaagacacccagtcgggacgcctccagccggctgagccttcggagggttcttcatcactaggaactggctctcctagaatacaactaataacactaaaaggatgatggacagcagcctgagagacacaatctgacggaaggacattccccaagaagggccaaacgtgtgtggtgcactacacaggaatgctccaaaatgggaagaagtttgattcatccagagacagaaacaaacctttcaagttcagaattggcaaacaggaagtcatcaaaggttttgaagagggtgcagcccagctgggtcctctttctcctctccccatctgcccccatccctgctagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcat

SEQ ID NO: 150658 - DNA, 1548 bp, Homo sapiens
  Payload ID: 9752
  Gene Symbol: MFSD3
  Gene Name: major facilitator superfamily domain containing 3
  Uniprot ID: Q96ES6
  ENST ID: ENST00000301327
  CDS Start-End: 261-1499
agcatgccgggagccgccggccgccggtgtccggaccgctcgcccccgtttggacccgacttcggttcttctggggtgttgatgctcctaaagcccgagagcacgtgtccagaccctagcctgtacgacgctgactctgcccggtcccagaaccaaagccatgccggggtgtggcctctgaccccacgcggaggggacctcgccttgcgggaccccacctggaacccgacctcccagcctcgcagccggcctgagccgccatgcgcgggaagttgctgccgctggccggcctctacctggtgcagggcctgccctacgggctccagtccggcctcctgccagtgctgctgcgtgccggcggcctctcgctgacgcgcgtggggctggccaaggttctgtacgctccgtggctgctcaagctggcttgggccccgctggtggacgcgcagggctcggcgagggcctgggtgacgcgcagcacggcgggcctgggcctggtgtgtgggctgcttgccgggctgccccctcctggagctggccaggccgggctgcccgccgctgtggcggggttgctgctgttgttgaacctgggtgccgccatgcaggatgtggccctggacgcgctggctgtgcagctgctggagccggccgaactggggccgggcaataccgtgcaggtggtcgcgtacaagctgggggccgcgctagctgggggcgcgctgctggcgctgctgcccaccttctcgtggccgcaactctttctgctcctggctgccacctactggctggccgcggccctggcctgggctgcaccagccctgcggcggctcccacagcagcccccttccgagcagcgtccccacaccgcgcaccttctgcgggacgtgctagccgtgccggggaccgtgtggacggcaggctttgtgctcacctacaagctgggtgagcagggtgccagcagcctgtttcctcttctcctgctggaccacggcgtttctgctcccgagttgggactgtggaatggtgtgggtgctgtggtctgctccatcgctggctcctccctgggtgggaccttgctggccaagcactggaaactgctgcctctgttgaggtcggtgctgcgcttccgcctcgggggcctagcctgtcagactgccttggtcttccacctggacaccctgggggccagcatggacgctggcacaatcttgagagggtcagccttgctgagcctatgtctgcagcacttcttgggaggcctggtcaccacagtcaccttcactgggatgatgcgctgcagccagctggcccccagggccctgcaggccacacactacagccttctggccacgctggagctgctggggaagctgctgctgggcactctggccggaggcctggctgatgggttggggccacatccctgcttcttgctcctgctcatcctctctgcctttcccgttctgtacctggacctagcacccagcacctttctctgagctgagtggctggagtggtcaataaagccacatgtgcctgtggcccaga

SEQ ID NO: 150659 - DNA, 4095 bp, Homo sapiens
  Payload ID: 9753
  Gene Symbol: MFSD4
  Gene Name: major facilitator superfamily domain containing 4
  Uniprot ID: Q8N468
  ENST ID: ENST00000367147
  CDS Start-End: 94-1638
cgcgggcctccccagcccggccggccctcccgcgggcggcactcgggcaccgggctcgccgggaccagatccgcgagcccgtcagcctgcgccatgggctgcgacggccgcgtgtcggggctgctccgccgcaacctgcagcccacgctcacctactggagcgtcttcttcagcttcggcctgtgcatcgccttcctggggcccacgctgctggacctgcgctgtcagacgcacagctcgctgccccagatctcctgggtcttcttctcgcagcagctctgcctcctgctgggcagcgccctcgggggcgtcttcaaaaggaccctggcccagtcactatgggccctgttcacctcctctctggccatctccctggtgtttgccgtcatccccttctgccgcgacgtgaaggtgctggcctcagtcatggcgctggcgggcttggccatgggctgcatcgacaccgtggccaacatgcagctggtaaggatgtaccagaaggactcggccgtcttcctccaggtgctccatttcttcgtgggctttggtgctctgctgagcccccttattgctgaccctttcctgtctgaggccaactgcttgcctgccaatagcacggccaacaccacctcccgaggccacctgttccatgtctccagggtgctgggccagcaccacgtagatgccaagccttggtccaaccagacgttcccagggctgactccaaaggacggggcagggacccgagtgtcctatgccttctggatcatggccctcatcaatcttccagtgcccatggctgtgctgatgctgctgtccaaggagcggctgctgacctgctgtccccagaggaggcccctgcttctgtctgctgatgagcttgccttggagacacagcctcctgagaaggaagatgcctcctcactgcccccaaagtttcagtcacacctagggcatgaggacctgttcagctgctgccaaaggaagaacctcagaggagccccttattccttctttgccatccacatcacgggcgccctggtactgttcatgacggatgggttgacgggtgcctattccgccttcgtgtacagctatgctgtggagaagcccctgtctgtgggacacaaggtggctggctacctccccagcctcttctggggcttcatcacactgggccggctcctctccattcccatatcctcaagaatgaagccggccaccatggttttcatcaacgtggttggcgtggtggtgacgttcctggtgctgcttattttctcctacaacgtcgtcttcctgttcgtggggacggcaagcctgggcctgtttctcagcagcaccttccccagcatgctggcctacacggaggactcgctgcagtacaaaggctgtgcaaccacagtgctggtgacaggggcaggagttggcgagatggtgctgcagatgctggttggttcgatattccaggctcagggcagctatagtttcctggtctgtggcgtgatctttggttgtctggcttttaccttctatatcttgctcctgtttttccacaggatgcaccctggactcccatcagttcctacccaagacagatcaattggaatggaaaactctgagtgctaccagaggtaaaactgggtgaagaaggcaagagaagactttcagcctcttgatcaccagcacgaccatactgtttcagaaagctgggtggtggtggaggcgctctctcaatggctattcaagtcttctccactaaaacttggttgggtagaggaaattaaattgagtcctggtacctggtcaaaatcattagaagtttacctggcttctcaagttatcttcttccctggttcagactgttggtaagagctgtccagatacccagatgggaaggaaggagacagccgcgcgcttcactccatttgtcacctcatgcatggaccatactctgggtttgagatcattcttcattgaagtttgtaaaaataggttgaaattgtaaagctccatgatcattgctatatgtagatatatttcaatttaagcaaaacaagctgcaagttattccctggcatgctcaaaggattttcgtgcttttcacttaatagtccaaagtctcttaaattcctgctgcagacatcaatagcttatctatattctcaaacaccaaaaggaaaagttgaatcttgctctctttggtatactaatgtagtggtatgctaagctggctcataccaacttagaaaagctgattgtaaaattttcattttgacagctggttattaaatgcagccattattaaaaatcaaatcatacaaacttataattaaatcaattacatttaaaacaaaggtaataaatattcaaagcatatcacttcctaatttgatcttgatgctcttgaggtaatttacgtccatggtacctgtgtggtggaattactatatatgatggtgtgctactgtgcaccttgtctcaactccactcttcgtgatagcatgttggtagcttgaaatcagcctggtgggagtattaccatggacactggcaaaagctacagatcccggagagccagtggttaaacatttaccagcataccactgctagtaatcaaggctaactggtccagaaatcgcccaggagaatgaaatggatgttccatttttttctactgacattgactagcatataaaaggtatagaaacagcactaagactttctgaaaatacctaatgaaaattttacatctttttttgtttttgtttttgtttttgagacagagtctcactctgttgccaggctggaatgcagtggcgtcatctcggctcactgcaacctccgcctcccagtttcaagcgattctcctgcctcagcctcccaagtagctgtgactacaggcgcatgccatcacgcacagctaattttttgtatttttagtagagacgggatttcaccgtgttagccaggatggtcttgatctcctgacctcatgatctgcccgtctcggcctcccaaagtgctgggattacaggcgtgagccactgcacccagccaaaaattttacatcttttatagagggaaaaaaactctttataccatggcaaggccttttctttcacaaaaagctgggcctactgaacaattcaagctgtgcagtagtagactgaaagcaggatttgttgaggagttacagctcctgtccagagcaaatcctgtagtgatacaaggagaatgtaaacttgccagcttagacagggatcagtcctgagactgctggcagtagcaaatggctattagagtaactgtataatggttttgcctgcactttctctatgtatatacaaatgtacatgtataaatataaaaattaagtgatcatggttcttggtaacctgtcccaagtgctgtgattcacacgcctgacactaaaaggttcttcctggtccagtcagccagctgtgaccaccagcagcacagctgagtgctgagaatctggctggaaagagaaacgtggctcaagtgctggctcaccttctagctgtgtggccctgggcaggttactgaggctcttccaacctcacttttcacatgtaaaatggcatttctaaaagtacctaccctacctcaaaggaattctgaaaaaagtaagtgaatttgtataaagcaaagcactcacaatatgcctgacacacaaactgcttaataaatgttagtaatttttaaaacctcctcataagcggcttagaaattattcatgtttggtacatatttattgcaagtcaagcagatccaacttttttgaaagctggtggtctaggagtatagttttaattatatttgtaaatactcaaaagtattagatgccagtctaatttaaatgcagtctgactgtagcgagtaactgacctgggcaatgaaaaagcagttgtatttttcttgtggtttttcaagaaaatatcctttttatacagatttagaaagaagaatcaatggctatatcgaagttgattgtgactaatttgttaatacagaaaacaacattaacacaaatctaagagtacctttcctaaaataaaatatttaaactta

SEQ ID NO: 150660 - DNA, 1841 bp, Homo sapiens
  Payload ID: 9753
  Gene Symbol: MFSD4
  Gene Name: major facilitator superfamily domain containing 4
  ENST ID: ENST00000536357
  CDS Start-End: 121-1500
gttatctgagcagactttgacaacttgcccacagctaataagtgagcagcttcttcctcagctctcttccttttctaccagagggggagaaatgtcttggctgcccagaccacccagtgaatggaggagaagggggaggggatgcttccagccccatcccctgacatcacccttccctcctgcagcctggcccagtcactatgggccctgttcacctcctctctggccatctccctggtgtttgccgtcatccccttctgccgcgacgtgaaggtgctggcctcagtcatggcgctggcgggcttggccatgggctgcatcgacaccgtggccaacatgcagctggtaaggatgtaccagaaggactcggccgtcttcctccaggtgctccatttcttcgtgggctttggtgctctgctgagcccccttattgctgaccctttcctgtctgaggccaactgcttgcctgccaatagcacggccaacaccacctcccgaggccacctgttccatgtctccagggtgctgggccagcaccacgtagatgccaagccttggtccaaccagacgttcccagggctgactccaaaggacggggcagggacccgagtgtcctatgccttctggatcatggccctcatcaatcttccagtgcccatggctgtgctgatgctgctgtccaaggagcggctgctgacctgctgtccccagaggaggcccctgcttctgtctgctgatgagcttgccttggagacacagcctcctgagaaggaagatgcctcctcactgcccccaaagtttcagtcacacctagggcatgaggacctgttcagctgctgccaaaggaagaacctcagaggagccccttattccttctttgccatccacatcacgggcgccctggtactgttcatgacggatgggttgacgggtgcctattccgccttcgtgtacagctatgctgtggagaagcccctgtctgtgggacacaaggtggctggctacctccccagcctcttctggggcttcatcacactgggccggctcctctccattcccatatcctcaagaatgaagccggccaccatggttttcatcaacgtggttggcgtggtggtgacgttcctggtgctgcttattttctcctacaacgtcgtcttcctgttcgtggggacggcaagcctgggcctgtttctcagcagcaccttccccagcatgctggcctacacggaggactcgctgcagtacaaaggctgtgcaaccacagtgctggtgacaggggcaggagttggcgagatggtgctgcagatgctggttggttcgatattccaggctcagggcagctatagtttcctggtctgtggcgtgatctttggttgtctggcttttaccttctatatcttgctcctgtttttccacaggatgcaccctggactcccatcagttcctacccaagacagatcaattggaatggaaaactctgagtgctaccagaggtaaaactgggtgaagaaggcaagagaagactttcagcctcttgatcaccagcacgaccatactgtttcagaaagctgggtggtggtggaggcgctctctcaatggctattcaagtcttctccactaaaacttggttgggtagaggaaattaaattgagtcctggtacctggtcaaaatcattagaagtttacctggcttctcaagttatcttcttccctggttcagactgttggtaagagctgtccagatacccagatgggaaggaaggagacagccgcgcgcttcactccatttgtcacctcatgcatggaccatactctgggtttgagatcattcttcattg

SEQ ID NO: 150661 - DNA, 1883 bp, Homo sapiens
  Payload ID: 9753
  Gene Symbol: MFSD4
  Gene Name: major facilitator superfamily domain containing 4
  ENST ID: ENST00000539267
  CDS Start-End: 87-1409
ctccccagcccggccggccctcccgcgggcggcactcgggcaccgggctcgccgggaccagatccgcgagcccgtcagcctgcgccatgggctgcgacggccgcgtgtcggggctgctccgccgcaacctgcagcccacgctcacctactggagcgtcttcttcagcttcggcctgtgcatcgccttcctggggcccacgctgctggacctgcgctgtcagacgcacagctcgctgccccagatctcctgggtcttcttctcgcagcagctctgcctcctgctgggcagcgccctcgggggcgtcttcaaaaggaccctggcccagtcactatgggccctgttcacctcctctctggccatctccctggtgtttgccgtcatccccttctgccgcgacgtgaaggtgctggcctcagtcatggcgctggcgggcttggccatgggctgcatcgacaccgtggccaacatgcagctggtaaggatgtaccagaaggactcggccgtcttcctccaggtgctccatttcttcgtgggctttggtgctctgctgagcccccttattgctgaccctttcctgtctgaggccaactgcttgcctgccaatagcacggccaacaccacctcccgaggccacctgttccatgtctccagggtgctgggccagcaccacgtagatgccaagccttggtccaaccagacgttcccagggctgactccaaaggacggggcagggacccgagtgtcctatgccttctggatcatggccctcatcaatcttccagtgcccatggctgtgctgatgctgctgtccaaggagcggctgctgacctgctgtccccagaggaggcccctgcttctgtctgctgatgagcttgccttggagacacagcctcctgagaaggaagatgcctcctcactgcccccaaagtttcagtcacacctagggcatgaggacctgttcagctgctgccaaaggaagaacctcagaggagccccttattccttctttgccatccacatcacgggcgccctggtactgttcatgacggatgggttgacgggtgcctattccgccttcgtgtacagctatgctgtggagaagcccctgtctgtgggacacaaggtggctggctacctccccagcctcttctggggcttcatcacactgggccggctcctctccattcccatatcctcaagaatgaagccggccaccatggttttcatcaacgtggttggcgtggtggtgacgttcctggtgctgcttattttctcctacaacgtcgtcttcctgttcgtggggacggcaagcctgggcctgtttctcagcagcaccttccccagcatgctggcctacacggaggactcgctgcagtacaaagatattccaggctcagggcagctatagtttcctggtctgtggcgtgatctttggttgtctggcttttaccttctatatcttgctcctgtttttccacaggatgcaccctggactcccatcagttcctacccaagacagatcaattggaatggaaaactctgagtgctaccagaggtaaaactgggtgaagaaggcaagagaagactttcagcctcttgatcaccagcacgaccatactgtttcagaaagctgggtggtggtggaggcgctctctcaatggctattcaagtcttctccactaaaacttggttgggtagaggaaattaaattgagtcctggtacctggtcaaaatcattagaagtttacctggcttctcaagttatcttcttccctggttcagactgttggtaagagctgtccagatacccagatgggaaggaaggagacagccgcgcgcttcactccatttgtcacctcatgcatggaccatactctgggtt

SEQ ID NO: 150662 - DNA, 1136 bp, Homo sapiens
  Payload ID: 9753
  Gene Symbol: MFSD4
  Gene Name: major facilitator superfamily domain containing 4
  ENST ID: ENST00000489709
  CDS Start-End: 50-1135
gggcaccgggctcgccgggaccagatccgcgagcccgtcagcctgcgccatgggctgcgacggccgcgtgtcggggctgctccgccgcaacctgcagcccacgctcacctactggagcgtcttcttcagcttcggcctgtgcatcgccttcctggggcccacgctgctggacctgcgctgtcagacgcacagctcgctgccccagatctcctgggtcttcttctcgcagcagctctgcctcctgctgggcagcgccctcgggggcgtcttcaaaaggaccctggcccagtcactatgggccctgttcacctcctctctggccatctccctggtgtttgccgtcatccccttctgccgcgacgtgaaggtgctggcctcagtcatggcgctggcgggcttggccatgggctgcatcgacaccgtggccaacatgcagctggtaaggatgtaccagaaggactcggccgtcttcctccaggtgctccatttcttcgtgggctttggtgctctgctgagcccccttattgctgaccctttcctgtctgaggccaactgcttgcctgccaatagcacggccaacaccacctcccgaggccacctgttccatgtctccagggtgctgggccagcaccacgtagatgccaagccttggtccaaccagacgttcccagggctgactccaaaggacggggcagggacccgagtgtcctatgccttctggatcatggccctcatcaatgttggcgtggtggtgacgttcctggtgctgcttattttctcctacaacgtcgtcttcctgttcgtggggacggcaagcctgggcctgtttctcagcagcaccttccccagcatgctggcctacacggaggactcgctgcagtacaaaggctgtgcaaccacagtgctggtgacaggggcaggagttggcgagatggtgctgcagatgctggttggttcgatattccaggctcagggcagctatagtttcctggtctgtggcgtgatctttggttgtctggcttttaccttctatatcttgctcctgtttttccacaggatgcaccctggactcccatcagttcctacccaagacagatcaattggaatggaaaactctgagtgctaccagaggtaaa

SEQ ID NO: 150663 - DNA, 477 bp, Homo sapiens
  Payload ID: 9753
  Gene Symbol: MFSD4
  Gene Name: major facilitator superfamily domain containing 4
  ENST ID: ENST00000621216
  CDS Start-End: 100-477
aacttgcccacagctaataagtgagcagcttcttcctcagctctcttccttttctaccagagggggagaaatgtcttggctgcccagaccacccagtgaatggaggagaagggggaggggatgcttccagccccatcccctgacatcacccttccctcctgcagcctggcccagtcactatgggccctgttcacctcctctctggccatctccctggtgtttgccgtcatccccttctgccgcgacgtgaaggtgctggcctcagtcatggcgctggcgggcttggccatgggctgcatcgacaccgtggccaacatgcagctggtaaggatgtaccagaaggactcggccgtcttcctccagcttccagtgcccatggctgtgctgatgctgctgtccaaggagcggctgctgacctgctgtccccagaggaggcccctgcttctgtctgctgatgagcttgccttggagacacag

SEQ ID NO: 150664 - DNA, 1475 bp, Homo sapiens
  Payload ID: 9753
  Gene Symbol: MFSD4
  Gene Name: major facilitator superfamily domain containing 4
  ENST ID: ENST00000475956
  CDS Start-End: 186-452
gcccacccgccgcagaggcgcccccgccgccgcccgggcccaagggcggggcccctcgctggggcggcccctccccgcccctccctccccgccgcgggcctccccagcccggccggccctcccgcgggcggcactcgggcaccgggctcgccgggaccagatccgcgagcccgtcagcctgcgccatgggctgcgacggccgcgtgtcggggctgctccgccgcaacctgcagcccacgctcacctactggagcgtcttcttcagcttcggcctgtgcatcgccttcctggggcccacgctgctggacctgcgctgtcagacgcacagctcgctgccccagatctcctgggtcttcttctcgcagcagctctgcctcctgctgggcagcgccctcgggggcgtcttcaaaaggacgtgctccatttcttcgtgggctttggtgctctgctgagcccccttattgctgaccctttcctgtctgaggccaactgcttgcctgccaatagcacggccaacaccacctcccgaggccacctgttccatgtctccagggtgctgggccagcaccacgtagatgccaagccttggtccaaccagacgttcccagggctgactccaaaggacggggcagggacccgagtgtcctatgccttctggatcatggccctcatcaatcttccagtgcccatggctgtgctgatgctgctgtccaaggagcggctgctgacctgctgtccccagaggaggcccctgcttctgtctgctgatgagcttgccttggagacacagcctcctgagaaggaagatgcctcctcactgcccccaaagtttcagtcacacctagggcatgaggacctgttcagctgctgccaaaggaagaacctcagaggagccccttattccttctttgccatccacatcacgggcgccctggtactgttcatgacggatgggttgacgggtgcctattccgccttcgtgtacagctatgctgtggagaagcccctgtctgtgggacacaaggtggctggctacctccccagcctcttctggggcttcatcacactgggccggctcctctccattcccatatcctcaagaatgaagccggccaccatggttttcatcaacgtggttggcgtggtggtgacgttcctggtgctgcttattttctcctacaacgtcgtcttcctgttcgtggggacggcaagcctgggcctgtttctcagcagcaccttccccagcatgctggcctacacggaggactcgctgcagtacaaaggctgtgcaaccacagtgctggtgacaggggcaggagttggcgagatggtgctgcagatgctggttggttcgatattccaggctcagggcagctatagtttcctggtctgtggcgtgatctttggttgtctggcttttaccttctatatcttgctcctgtttttccacaggatgcaccctggactcccatcag

SEQ ID NO: 150665 - DNA, 542 bp, Homo sapiens
  Payload ID: 9753
  Gene Symbol: MFSD4
  Gene Name: major facilitator superfamily domain containing 4
  ENST ID: ENST00000616173
  CDS Start-End: 180-542
gtgaagtgtcctgcagccaccttgtgaggtagattgttatctgagcagactttgacaacttgcccacagctaataacctggcccagtcactatgggccctgttcacctcctctctggccatctccctggtgtttgccgtcatccccttctgccgcgacgtgaaggtgctggcctcagtcatggcgctggcgggcttggccatgggctgcatcgacaccgtggccaacatgcagctggtaaggatgtaccagaaggactcggccgtcttcctccaggtgctccatttcttcgtgggctttggtgctctgctgagcccccttattgctgaccctttcctgtctgaggccaactgcttgcctgccaatagcacggccaacaccacctcccgaggccacctgttccatgtctccagggtgctgggccagcaccacgtagatgccaagccttggtccaaccagacgttcccagggctgactccaaaggacggggcagggacccgagtgtcctatgccttctggatcatggccctcatcaatcttcca

SEQ ID NO: 150666 - DNA, 1760 bp, Homo sapiens
  Payload ID: 9754
  Gene Symbol: MFSD5
  Gene Name: major facilitator superfamily domain containing 5
  Uniprot ID: Q6N075
  ENST ID: ENST00000329548
  CDS Start-End: 192-1544
cgtgatgaagccatcatggcggcggccagaggcctgcccggctcccggaagcaggctgtgaggggcgggagcgctgctggaacccgagccggagccggagccacagcggggagggtggcctggcggcctggagccggacgtgtccggggcgtccccgcagaccggggcagcaggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgat

SEQ ID NO: 150667 - DNA, 2038 bp, Homo sapiens
  Payload ID: 9754
  Gene Symbol: MFSD5
  Gene Name: major facilitator superfamily domain containing 5
  Uniprot ID: Q6N075
  ENST ID: ENST00000534842
  CDS Start-End: 148-1821
actgggaagttatgcggcttgcccaaggccacacagctggtaagtgacaggggcaggactgcgccttagtctgtctgcagcccgactccaagttctttacaccacaccgcctccctcaggtgtctggaccatactggcttctcttgcatggaggtcactgcagtgggagaggaggcaaaccaaggagaccttctcggcttcgggcagcggtgctgttccttaggaagctccaacccttggctctaccggactgcgggcatctttcccgagcactgcacggaagaaaagaaaattggcacttatttcagggtggcccctcaggcatccaagagccagaggagcaggtgtcacgggatggcagcgagcgaggccaggccaggagaagcaaccgcagcctcctatggtcgccccttcccgacccaccccaggcgtcaggagttccgcgcccgggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatc

SEQ ID NO: 150668 - DNA, 1318 bp, Homo sapiens
  Payload ID: 9754
  Gene Symbol: MFSD5
  Gene Name: major facilitator superfamily domain containing 5
  ENST ID: ENST00000551660
  CDS Start-End: 81-1318
agtctgtctgcagcccgactccaagttctttacaccacaccgcctccctcaggtgtctggaccatactggcttctcttgcatggaggtcactgcagtgggagaggaggcaaaccaaggagaccttctcggcttcgggcagcggtgctgttccttaggaagctccaacccttggctctaccggactgcgggcatctttcccgagcactgcacggaagaaaagaaaattggcacttatttcagggtggcccctcaggcatccaagagccagaggagcaggtgtcacgggatggcagcgagcgaggccaggccaggagaagcaaccgcagcctcctatggtcgccccttcccgacccaccccaggcgtcaggagttccgcgcccgggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagag

SEQ ID NO: 150669 - DNA, 4608 bp, Homo sapiens
  Payload ID: 9755
  Gene Symbol: MFSD6
  Gene Name: major facilitator superfamily domain containing 6
  Uniprot ID: Q6ZSS7
  ENST ID: ENST00000281416
  CDS Start-End: 136-2511
cttaatttcctgcaagatgaagttctgtgtttacatgttatgattttcattactaagccatcttttaaattttactttacagatcaacagtacaaattctgaagtttgtaaacttgctgatggtggtggtaagccatggcagatgataaagttgctatcttaacggatgatgaagaggaacagaagagaaagtatgtgcttgcagatccctttaatggtatttccagggaaccagaaccaccttcgaatgaaacaccttcctccacagaaacatctgctattcctgaggaggaaatagactggatagagaaacattgtgttaagataaacaacgatcttctaatttccaaggtcttttattttttcttttactctgcctatggctctctctatccccttttgcctgtgtattacaaacagctgggaatgtctccaagccagagtggactactagtaggtattcgttacttcattgaattctgcagtgcccccttttggggtgtagttgcagaccgctttaaaaaaggcaaaattgtcctcctcttttctcttttgtgttgggttttattcaacctgggcattggatttgtcaaacctgctaccttgagatgtgtaccaaagattcgcccaacaactcaccccaccaatgcaagtcaccagttaactatcctgccaacaaattcttcctttacctctttcctcaccatatcaccaaaaatgcgtgagaaaagaaaccttttggaaacaaggctcaatgtctcagacaccgttactttgccaacagctccaaacatgaacagtgaacccactctgcagccccagacaggtgaaattactaaccgtatgatggacttgactttgaactcaagcacagcaacccctgtctccccaggaagcgtaaccaaggagacaaccactgttattgttaccaccaccaaatctttaccttctgaccaagtcatgcttgtttatgatcaacaagaagttgaagctatattcttggtgatcttggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattacat

SEQ ID NO: 150670 - DNA, 4797 bp, Homo sapiens
  Payload ID: 9755
  Gene Symbol: MFSD6
  Gene Name: major facilitator superfamily domain containing 6
  Uniprot ID: Q6ZSS7
  ENST ID: ENST00000392328
  CDS Start-End: 325-2700
gtcgcagccccggaggagcgcgcgagcagcccgggatggtgcgcgctgccccgacagccgccgccccggcgccccgagccgccgccccgtgctccggggacagggctccccgcgccccgcgcagctgagcgctgccgccgccgcagcagacaggatctctctcagttacccaggccggagtgcagtggcgtgatcctagctcactgcagccttgaacccctgggctcaagtgattctcctgccttggcctcctgaatagctagaactacagatcaacagtacaaattctgaagtttgtaaacttgctgatggtggtggtaagccatggcagatgataaagttgctatcttaacggatgatgaagaggaacagaagagaaagtatgtgcttgcagatccctttaatggtatttccagggaaccagaaccaccttcgaatgaaacaccttcctccacagaaacatctgctattcctgaggaggaaatagactggatagagaaacattgtgttaagataaacaacgatcttctaatttccaaggtcttttattttttcttttactctgcctatggctctctctatccccttttgcctgtgtattacaaacagctgggaatgtctccaagccagagtggactactagtaggtattcgttacttcattgaattctgcagtgcccccttttggggtgtagttgcagaccgctttaaaaaaggcaaaattgtcctcctcttttctcttttgtgttgggttttattcaacctgggcattggatttgtcaaacctgctaccttgagatgtgtaccaaagattcgcccaacaactcaccccaccaatgcaagtcaccagttaactatcctgccaacaaattcttcctttacctctttcctcaccatatcaccaaaaatgcgtgagaaaagaaaccttttggaaacaaggctcaatgtctcagacaccgttactttgccaacagctccaaacatgaacagtgaacccactctgcagccccagacaggtgaaattactaaccgtatgatggacttgactttgaactcaagcacagcaacccctgtctccccaggaagcgtaaccaaggagacaaccactgttattgttaccaccaccaaatctttaccttctgaccaagtcatgcttgtttatgatcaacaagaagttgaagctatattcttggtgatcttggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacatgcctttgttatggaacatttactgtgacagcagaatcgataatgcagtcatttccagccttgtgagctgacaccttcatgggtttgtggactttgtgactttttcttcctgtccccaaagtgccatatgctaccttaaaaaatattaaagtgaattcaaattacat

SEQ ID NO: 150671 - DNA, 2902 bp, Homo sapiens
  Payload ID: 9755
  Gene Symbol: MFSD6
  Gene Name: major facilitator superfamily domain containing 6
  ENST ID: ENST00000434582
  CDS Start-End: 1-814
cacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacagttgcacataggaaaggagatgaaaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaatgtttcttaaatgataaagatgtgaccaaacaaaa

SEQ ID NO: 150672 - DNA, 517 bp, Homo sapiens
  Payload ID: 9755
  Gene Symbol: MFSD6
  Gene Name: major facilitator superfamily domain containing 6
  ENST ID: ENST00000417958
  CDS Start-End: 391-517
gtcgcagccccggaggagcgcgcgagcagcccgggatggtgcgcgctgccccgacagccgccgccccggcgccccgagccgccgccccgtgctccggggacagggctccccgcgccccgcgcagctgagcgctgccgccgccgcagcagacaggatctctctcagttacccaggccggagtgcagtggcgtgatcctagctcactgcagccttgaacccctgggctcaagtgattctcctgccttggcctcctgaatagctagaactacagatgatgaaatggaattggagccgctgagctggataggtgaaggcactaatgatgaaggaaaaatagatcaacagtacaaattctgaagtttgtaaacttgctgatggtggtggtaagccatggcagatgataaagttgctatcttaacggatgatgaagaggaacagaagagaaagtatgtgcttgcagatccctttaatggtatttccagggaaccagaaccaccttcgaatgaaacaccttcct

SEQ ID NO: 150673 - DNA, 546 bp, Homo sapiens
  Payload ID: 9755
  Gene Symbol: MFSD6
  Gene Name: major facilitator superfamily domain containing 6
  ENST ID: ENST00000432036
  CDS Start-End: 203-546
gtcgcagccccggaggagcgcgcgagcagcccgggatggtgcgcgctgccccgacagccgccgccccggcgccccgagccgccgccccgtgctccggggacagggctccccgcgccccgcgcagctgagcgctgccgccgccgcagcagatcaacagtacaaattctgaagtttgtaaacttgctgatggtggtggtaagccatggcagatgataaagttgctatcttaacggatgatgaagaggaacagaagagaaagtatgtgcttgcagatccctttaatggtatttccagggaaccagaaccaccttcgaatgaaacaccttcctccacagaaacatctgctattcctgaggaggaaatagactggatagagaaacattgtgttaagataaacaacgatcttctaatttccaaggtcttttattttttcttttactctgcctatggctctctctatccccttttgcctgtgtattacaaacagctgggaatgtctccaagccagagtggactactagtaggtattcgttacttcattgaatt

SEQ ID NO: 150674 - DNA, 551 bp, Homo sapiens
  Payload ID: 9755
  Gene Symbol: MFSD6
  Gene Name: major facilitator superfamily domain containing 6
  ENST ID: ENST00000445546
  CDS Start-End: 83-551
aatcttatctgatacagagtgctaaataaatcaacagtacaaattctgaagtttgtaaacttgctgatggtggtggtaagccatggcagatgataaagttgctatcttaacggatgatgaagaggaacagaagagaaagtatgtgcttgcagatccctttaatggtatttccagggaaccagaaccaccttcgaatgaaacaccttcctccacagaaacatctgctattcctgaggaggaaatagactggatagagaaacattgtgttaagataaacaacgatcttctaatttccaaggtcttttattttttcttttactctgcctatggctctctctatccccttttgcctgtgtattacaaacagctgggaatgtctccaagccagagtggactactagtaggtattcgttacttcattgaattctgcagtgcccccttttggggtgtagttgcagaccgctttaaaaaaggcaaaattgtcctcctcttttctcttttgtgttgggttttattcaacctgggcattggatttgtcaaacctgctacct

SEQ ID NO: 150675 - DNA, 502 bp, Homo sapiens
  Payload ID: 9755
  Gene Symbol: MFSD6
  Gene Name: major facilitator superfamily domain containing 6
  ENST ID: ENST00000412482
  CDS Start-End: 1-275
cactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacaggtgtatcttacaaaagtattactagtgatgaactagagggaaactggtccatcaccccagacagtctgagaagcactgacaagagccgcagactacagtgtccattgctgcggggcacaaatgactgaatgaagtcaacttgaaggtcgcatgtcaggcagtactcgggt

SEQ ID NO: 150676 - DNA, 777 bp, Homo sapiens
  Payload ID: 9755
  Gene Symbol: MFSD6
  Gene Name: major facilitator superfamily domain containing 6
  ENST ID: ENST00000444317
  CDS Start-End: 240-777
acttttatattaacaagcattttgaaaaggctgagggcagatatgttagaagccatcttcttattcctaaattcatgcttaaatgtaattgtccttcagttttcccactcctgagtttggagtctgctggatgatgggtggtttggggaaggaaaagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgctt

SEQ ID NO: 150677 - DNA, 2188 bp, Homo sapiens
  Payload ID: 9756
  Gene Symbol: MFSD6L
  Gene Name: major facilitator superfamily domain containing 6-like
  Uniprot ID: Q8IWD5
  ENST ID: ENST00000329805
  CDS Start-End: 230-1990
cgcctctccctccgggcggggcccctttcggtccaacggcaggacctgggggctgtggccgggggcggccgttgacctggtgaccgcggcgccgccccagaccgggggcgcagtcccactcgctccgagccccggtcccccaagcctccctcccgggtacctggggccgcgcccgccctgcgcccagctccgccctccgtcggcccaggcctgacagagcccggcagccatgagtgccaacccccggtgggacatcagcagggcgctgggggtggccaagctcttccacctggtgtgcggggtgcgggaagcctgcgtgaccccgttcctgaccctttacctgaggcagctgggcttggccgcgccctgggtgggcaccctaatgggaaccaagcacctaatcgctgccttctgggctcccgtctgtgccttcctggccaaaagctaccggaaaaggagagcgcttctgatcggctccctgctcggctcggtgggggccagcctgctgatggtcctggtcccaccggtagacaaaaatcgggtgcacttcccttgtaatggaagcagcggcctgaccagcacagacgcactcccgggggtcacgctacctgtgaacatcacctcggcccaagagtctgcctccagccacccagccaagaggactgcagaggtggaaatgcctggcttcagaaacccacctggtgaaagtgaccgagaaactttccgtgatctgcacgtctacttagcgccctccgttgaaggagctaggaccacatcccaagctctcctccatcctgtcacttcggggctgaaagatcatccctgggaagttacttttgaggtggtcaagacagccctccccttgcttcctggggggaaagggcccgggaatccagccaatttgtcagggaccaaggggaaagcctgggcttttgacctgtccttggaggcgttgcggcggacttttatcctctccttggggtccgtggcgttctgggagctgctgacagcgcctctggagcaggtggcagatgacagcctttatgagttcctggattttgtggatgccactgaccgatacagaagcctgtgggtctggaggttgctgggcatgtcggcaggcgtgtgtggcatcacagccttggtggggcagctggactgcttcctgatgaccagtggcccccgaggtgtggtccacttctatgggtactcggtggtcagcaccctggccttactggtgagcattgcctttcccattcccatctgtcagcagtgggagcccagctacaaaagggtcaaagcactgtccattgtggggggtgacccccacctcattctcctcgcctccaccactgttttggtaggagccatcgtcagtactgtccagaactttctgttctggcacatgaaggaccatgggagcggcgagctggtcatgggtttctcggtcgccctcagcttgctgggggaaattctgcttcatccgttcaaagctacattgcttaggaaactgtccaggacgggcctggtggggctggggctgagctgcctcgctgggcagctgctgtactactctttcctctggagctggtggtccgtcctccccattcagatcttgagtgccattagcaacagagctttgtggtgggctgtgggggcctcagtagaggacctggccactccccgcatggagagggctctgagtgccttgttccgaggccacttttacgggagtggctgtagcctgggcagctttgtcgggggcttcgtggtgatgcgcttcagcctggctgtgctctaccaggcctgctgtgtggccctgttgctctggttggccttgctcctgtccatacagcggaggctgccccgagagcggaaaatcaagtactcgaagctgctgtccatggaggtgagtgacaccagtgactctgagcaggggacagaacaggactggcttgtgaaggccatgagggaggaacactcagactgaaagggctgagaaatccagagtgtgctgatccagcaaggaacgaatggactgaacaaaactcagcctgctgaggacagaaacctgccctggactgctgggagccggggaagagaggatgggtctgtgctgaaggcccaacaggatcatctcattgcatgattttctttacttttgaagtaaaaggagatttaacttttt

SEQ ID NO: 150678 - DNA, 1599 bp, Homo sapiens
  Payload ID: 9757
  Gene Symbol: MFSD7
  Gene Name: major facilitator superfamily domain containing 7
  Uniprot ID: Q6UXD7
  ENST ID: ENST00000347950
  CDS Start-End: 145-1470
gtagtccttggggcggaactggccccccgtggcccggcccggcccggccccacctccgcccgcaggcggtcccggcccacgcgggaaggtccttaagcccgggcggccggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgatcaactggctgtcactggtctacctcgtggtatccaccccatttggcgtggcggccatctggatcctggactccgtcgggctccgtgcggcgctcggtgtctataccatccctgctggcgtcgtctgcctgctgtccaccatctgcctgtgggagagtgtgccccccaccccgccctctgccggggctgccagctccacctcagagaagttcctggatgggctcaagctgcagctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgcgggcgggggcgaaagggctccttgcgggctccgggagcgaattacaagcgcgcacctgca

SEQ ID NO: 150679 - DNA, 2123 bp, Homo sapiens
  Payload ID: 9757
  Gene Symbol: MFSD7
  Gene Name: major facilitator superfamily domain containing 7
  Uniprot ID: Q6UXD7
  ENST ID: ENST00000322224
  CDS Start-End: 315-1994
ctgagaagcacacaggctgtgaccggggcccttcccggaagggacattcggtttttgtggcagggacttccagcctgaggccgaaggaggagggtccaacttcacctttgcccgcccttcccccgcttttttgggtctcctttaactgggacggggcgggaccctcctccgtagtccttggggcggaactggccccccgtggcccggcccggcccggccccacctccgcccgcaggcggtcccggcccacgcgggaaggtccttaagcccgggcggccggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgaccatcctgggtgcgtggctgaactttgccgggagtgtgctacgcatggtgccctgcatggttgttgggacccaaaacccatttgccttcctcatgggtggccagagcctctgtgcccttgcccagagcctggtcatcttctctccagccaagctggctgccttgtggttcccagagcaccagcgagccacggccaacatgctcgccaccatgtcgaaccctctgggcgtccttgtggccaatgtgctgtcccctgtgctggtcaagaagggtgaggacattccgttaatgctcggtgtctataccatccctgctggcgtcgtctgcctgctgtccaccatctgcctgtgggagagtgtgccccccaccccgccctctgccggggctgccagctccacctcagagaagttcctggatgggctcaagctgctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgcgggcgggggcgaaagggctccttgcgggctccgggagcgaattacaagcgcgcacctgca

SEQ ID NO: 150680 - DNA, 1826 bp, Homo sapiens
  Payload ID: 9757
  Gene Symbol: MFSD7
  Gene Name: major facilitator superfamily domain containing 7
  Uniprot ID: Q6UXD7
  ENST ID: ENST00000404286
  CDS Start-End: 17-1699
gtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgaccatcctgggtgcgtggctgaactttgccgggagtgtgctacgcatggtgccctgcatggttgttgggacccaaaacccatttgccttcctcatgggtggccagagcctctgtgcccttgcccagagcctggtcatcttctctccagccaagctggctgccttgtggttcccagagcaccagcgagccacggccaacatgctcgccaccatgtcgaaccctctgggcgtccttgtggccaatgtgctgtcccctgtgctggtcaagaagggtgaggacattccgttaatgctcggtgtctataccatccctgctggcgtcgtctgcctgctgtccaccatctgcctgtgggagagtgtgccccccaccccgccctctgccggggctgccagctccacctcagagaagttcctggatgggctcaagctgcagctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgcgggcgggggcgaaagggctccttgcgggctccgggagcgaattacaagcgcgcacctg

SEQ ID NO: 150681 - DNA, 1556 bp, Homo sapiens
  Payload ID: 9757
  Gene Symbol: MFSD7
  Gene Name: major facilitator superfamily domain containing 7
  ENST ID: ENST00000515118
  CDS Start-End: 65-1456
gcgggaaggtccttaagcccgggcggccggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgctcggtgtctataccatccctgctggcgtcgtctgcctgctgtccaccatctgcctgtgggagagtgtgccccccaccccgccctctgccggggctgccagctccacctcagagaagttcctggatgggctcaagctgcagctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgcgggcgggggcgaaagggctccttgcgggctc

SEQ ID NO: 150682 - DNA, 938 bp, Homo sapiens
  Payload ID: 9757
  Gene Symbol: MFSD7
  Gene Name: major facilitator superfamily domain containing 7
  ENST ID: ENST00000507165
  CDS Start-End: 288-938
gcggggacaggtggctccgggaccctcagtccctcggaccagccgggttttgttttcctgtggccacagcccgaggtgccaggtgtggggcgttccttggacagtcaagggcctcctgctgcagttcttcactgttttattaatatccacgagtcatcatggagcacacagaaatctcaccctgacaccaagagtcgtcatggtctctgcctgggtcaccacagtgagccctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgaccatcctgggtgcgtggctgaactttgccgggagtgtgctacgcatggtgccctgcatggttgttgggacccaaaacccatttgccttcctcatgggtggccagagcctctgtgcccttgcccagagcctggtcatcttctctccagccaagctggctgccttgtggttcccagagcaccagcgagccacggccaacatgctcgccaccatgtcgaaccctctgggcgtccttgtggccaatgtgctgtcccctgtgctggtcaagaagggtgaggacattccgttaatgctcggtgtctataccatccctgctggcgtcgtctgcctgctgtccaccatctgcctgtgggagagtgtgccccccaccccgccctctgccggggctgccagctccacctcagagaagttcctggatgggctcaagctgcagctcatgtggaacaaggcctatgtcatcctggctgtgtgcttggggggaatgatcgggatctctgccagcttctcagccctcctggagcagatcctctgtgcaagcggccactccagt

SEQ ID NO: 150683 - DNA, 653 bp, Homo sapiens
  Payload ID: 9757
  Gene Symbol: MFSD7
  Gene Name: major facilitator superfamily domain containing 7
  ENST ID: ENST00000512249
  CDS Start-End: 57-653
gtccttaagcccgggcggccggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcggggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatcttt

SEQ ID NO: 150684 - DNA, 1632 bp, Homo sapiens
  Payload ID: 9757
  Gene Symbol: MFSD7
  Gene Name: major facilitator superfamily domain containing 7
  ENST ID: ENST00000503156
  CDS Start-End: 89-1351
ccttgagtgacacggcctcctgcctcccggactgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgaccatcctgggtgcgtggctgaactttgccgggagtgtgctacgcatggtgccctgcatggttgttgggacccaaaacccatttgccttcctcatgggtggccagagcctctgtgcccttgcccagagcctggtcatcttctctccagccaagctggctgccttgtggttcccagagcaccagcgagccacggccaacatgctcgccaccatgtcgaaccctctgggcgtccttgtggccaatgtgctgtcccctgtgctggtcaagaagggtgaggacattccgttaatgctcggtgtctataccatccctgctggcgtcgtctgcctgctgtccaccatctgcctgtgggagagtgtgccccccaccccgccctctgccggggctgccagctccacctcagagaagttcctggatgggctcaagctgctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgcgggcgggggcgaaagggctccttgcgg

SEQ ID NO: 150685 - DNA, 4510 bp, Homo sapiens
  Payload ID: 9758
  Gene Symbol: MFSD8
  Gene Name: major facilitator superfamily domain containing 8
  Uniprot ID: Q8NHS3
  ENST ID: ENST00000296468
  CDS Start-End: 129-1685
aggttacaagcagcagatcccaccttcagtcctggctctgacaagccctccagcttcacgccacccgggatgggagaaagcaggtgtcgcgagagttgggcgcaagacgccttgtagggagtgtaactatggccggcctgcggaacgaaagtgaacaggagccgctcttaggcgacacacctggaagcagagaatgggacattttagagactgaagagcattataagagccgatggagatctattaggattttatatcttactatgtttctcagcagtgtagggttttctgtagtgatgatgtccatatggccatatctccaaaagattgatccgacagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcaggaaatgtagcagttgttagatcatatactgctggtgctacttcccttcaggaaagaacaagttccatggcaaacataagcatgtgtcaagcattaggttttattctaggtccagtttttcagacttgttttacattccttggagaaaaaggtgtgacatgggatgtgattaaactgcagataaacatgtatacaacaccagttttacttagcgccttcctgggaattttaaatattattctgatccttgccatactaagagaacatcgtgtggatgactcaggaagacagtgtaaaagtattaattttgaagaagcaagtacagatgaagctcaggttccccaaggaaatattgaccaggttgctgttgtggccatcaatgttctgttttttgtgactctatttatctttgccctttttgaaaccatcattactccattaacaatggatatgtatgcctggactcaagaacaagctgtgttatataatggcataatacttgctgctcttggggttgaagccgttgttattttcttaggagttaagttgctttccaaaaagattggcgagcgtgctattctactgggaggactcatcgttgtatgggttggcttctttatcttgttaccttggggaaatcaatttcccaaaatacagtgggaagatttgcacaataattcaatccctaataccacatttggggaaattattattggtctttggaagtctccaatggaagatgacaatgaaagaccaactggttgctcgattgaacaagcctggtgcctctacaccccggtgattcatctggcccagttccttacatcagctgtgctaataggattaggctatccagtctgcaatcttatgtcctatactctatattcaaaaattctaggaccaaaacctcagggtgtatacatgggctggttaacagcatctggaagtggagcccggattcttgggcctatgttcatcagccaagtgtatgctcactggggaccacgatgggcattcagcctggtgtgtggaataatagtgctcaccatcaccctcctgggagtggtttacaaaagactcattgctctttctgtaagatatgggaggattcaggaataaactagctaagactgtgatggaaactacttgctgtgtggcacttcctggtctaaagctctgctagacaattgcggtgagccagtctccaagaatcagactacagatattgcagattttgaagaacaagaacatatgttgaataacagagagaattctacatgtcattgtgaatagtaggttatataaaaacatactagatgataatttccttacctcagaaatgaaatattattcttataatacctttttgtggttgcatgaactaatgagtgaatggacaatgatgaataaatgtgaagctgtattcttaatacccactgcagaagtgtcattaaaataatatacagtggaaccagaaagagggttctgtaagaattagccatagcagaacaaaattatagaattttaaatacctctacccaagtagaggtatttttattcagacacctactttttatttataaaaaaatgcattttctattatcaagttcacttatgaaataaaaattataacacatattttccatttagcgtgcctaacatcctaccttgccttctatgagtctttcttctaatactacacctctgccttattttagttcagggtttcactaagtaacccctacattaataaatgagtatggataatgctaatatttgagcaatacagaggattaagagatcaagatacttcactgcctattagcctaatagggatacctactttctttcaaatgccaaaaattcacattagaaacataatccagatatgtgttattttatatatatatatacaaaacagtaaatggtttcttaaaattattgctatttttcaacccccttaaactggagaaaaacatttaattagtaaaacattaattaatttactttaatttttcccatctctcagtagtggcggggaggaacacaacagttttcaatctatgtctgcatagttgtgtagagctgcagaattttagttggatttttaatttggatgatccctgacagccccaaactagtcaggctaataagtatttgaggcaaaatggctttaatctaacaatttactgagtttacctgaagttggctaaataacactgtatgtttaacttctacctctacataagttgaatgctgataaaaggaactagtagataactatgtatattgataagcactgttaagaaaatgcaaaaatatttctaaacacttttccaaatgttttctactttaagttagaaatagtttcaaatctgagaataaacactatataatctgcactttataggttgggtgcagtgtctcatgcctgtaatcccagcactttggaaggccaaggcaggaggattgcttgaggccaggaattcaagaccagcctgggaaacaaagtgagaccctgtctttacaaaaaataaaaacaaaaatttaaaactgtataatctgcactttatgctaaactagctgtgctcttaaactcaattttttcagctctaataaagggcttaatttgatagaattattctacgattaaattttgaagactgttttcactctcctctgccgcccatagcaagactgcttccatagatttctcagaaccgtagccagttctggctatttggtcaagtctgggatccctcttacctgctattctgcagctgctttctctgtcttacattttttgggccacgtctaatcttaaagagtaaactctacccttggtttgcatagtgtgcatgacaaaaataacaagaataatggtaatgatgaaaatgataagagcaaaatttgtggagtgctttccacattccaggtaatgtgtaacatacaatttaattcttacagcagtcttatggagtgaaaatactattatgattcccgttttacagatgaaagaatggaggcacagaaaagttacttgtctaagtaacagtctatccttaaagtccacagtcttaaccacttgatttttcatagtgaggaaaatatcccagaaagttgcagtttcaattaatcactaattgtagggtaatttaactataccagtgagtcctactagcagaaatatttgggcaacataagcccactgactggagcttttgtcttagcataataacctgtttccagcaagaatataacagaaaaaagtttcccagctttcaaaggtttataatattgattaaaatttagataaacttaaccttacacaaatgactcttactttcctttttattgagagcattttctttggagcattttcttctttggaggattataccttgctcatcttggcacaaaagaaggcgaaaggaagtaacatgggattgggaaaagagcaaggagataaagtttgaggaaaaaaaatcaccatgttgatgtcttcttgagtaggccaagttgcgtataaagagaaaatgacaacaggagattttaaggtatgatatattgttaagagtagtacatatttaagaagagaaaatatgtttttgaaaacaaatttaaacttgaaaggatgattttcatattttgaagggatttataacttcacaaagcatctccattctatcttgttcagctttacatttaaaaataaactcttcttgttcatataaaccttatctcttacataaagtgaaatctgttaattttttgttttgacaaggataaactacttacctgcatctgtttaagaatagattaacttattttgagaagaaattctgggcaccatttttgaccattgaagacttatttgtaatttaatttctactttacattgtgaatgttcattttctaataaacaagattattttgcatatgta

SEQ ID NO: 150686 - DNA, 910 bp, Homo sapiens
  Payload ID: 9758
  Gene Symbol: MFSD8
  Gene Name: major facilitator superfamily domain containing 8
  Uniprot ID: Q8NHS3
  ENST ID: ENST00000509826
  CDS Start-End: 116-577
agcagatcccaccttcagtcctggctctgacaagccctccagagaatgggacattttagagactgaagagcattataagagccgatggagatctattaggattttatatcttactatgtttctcagcagtgtagggttttctgtagtgatgatgtccatatggccatatctccaaaagattgatccgacagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcagtttttcagacttgttttacattccttggagaaaaaggtgtgacatgggatgtgattaaactgcagataaacatgtatacaacaccagttttacttagcgccttcctgggaattttaaatattattctgatccttgccatactaagcaagtacagatgaagctcaggttccccaaggaaatattgaccaggttgctgttgtggccatcaatgttctgttttttgtgactctatttatctttgccctttttgaaaccatcattactccattaacaatggatatgtatgcctggactcaagaacaagctgtgttatataatggcataatacttgctgctcttggggttgaagccgttgttattttcttaggagttaagttgctttccaaaaagattggcgagcgtgctattctactgggaggactcatcgttgtatgggttggcttctttatcttgttaccttggggaaatcaatttcccaaaatacagtggga

SEQ ID NO: 150687 - DNA, 1850 bp, Homo sapiens
  Payload ID: 9758
  Gene Symbol: MFSD8
  Gene Name: major facilitator superfamily domain containing 8
  ENST ID: ENST00000513559
  CDS Start-End: 141-1562
atccggggacctgcaggttacaagcagcagatcccaccttcagtcctggctctgacaagccctccagagaatgggacattttagagactgaagagcattataagagccgatggagatctattaggattttatatcttactatgtttctcagcagtgtagggttttctgtagtgatgatgtccatatggccatatctccaaaagattgatccgacagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcaggaaatgtagcagttgttagatcatatactgctggtgctacttcccttcaggaaagaacaagttccatggcaaacataagcatgtgtcaagcattaggttttattctaggtccagtttttcagacttgttttacattccttggagaaaaaggtgtgacatgggatgtgattaaactgcagataaacatgtatacaacaccagttttacttagcgccttcctgggaattttaaatattattctgatccttgccatactaagagaacatcgtgtggatgactcaggaagacagtgtaaaagtattaattttgaagaagcaagtacagatgaagctcaggttccccaaggaaatattgaccaggttgctgttgtggccatcaatgttctgttttttgtgactctatttatctttgccctttttgaaaccatcattactccattaacaatggatatgtatgcctggactcaagaacaagctgtgttatataatggcataatacttgctgctcttggggttgaagccgttgttattttcttaggagttaagttgctttccaaaaagattggcgagcgtgctattctactgggaggactcatcgttgtatgggttggcttctttatcttgttaccttggggaaatcaatttcccaaaatacagtgggaagatttgcacaataattcaatccctaataccacatttggggaaattattattggtctttggaagtctccaatggaagatgacaatgaaagaccaactggttgctcgattgaacaagcctggtgcctctacaccccggtgattcatctggcccagttccttacatcagctgtgctaataggattaggctatccagtctgcaatcttatgtcctatactctatattcaaaaattctaggaccaaaacctcagggtgtatacatgggctggttaacagcatctggaagtggagcccggattcttgggcctatgttcatcagccaagtgtatgctcactggggaccacgatgggcattcagcctggtgtgtggaataatagtgctcaccatcaccctcctgggagtggtttacaaaagactcattgctctttctgtaagatatgggaggattcaggaataaactagctaagactgtgatggaaactacttgctgtgtggcacttcctggtctaaagctctgctagacaattgcggtgagccagtctccaagaatcagactacagatattgcagattttgaagaacaagaacatatgttgaataacagagagaattctacatgtcattgtgaatagtaggttatataaaaacatactagatgataatttccttacctcagaaatgaaatattattcttataatacctttttgtggttgcatgaactaatgagtgaatggacaatgatgaa

SEQ ID NO: 150688 - DNA, 4049 bp, Homo sapiens
  Payload ID: 9759
  Gene Symbol: MFSD9
  Gene Name: major facilitator superfamily domain containing 9
  Uniprot ID: Q8NBP5
  ENST ID: ENST00000258436
  CDS Start-End: 45-1469
aggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtaggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtttacctggaagtctcttcttcccacctgggctaatcaggttacaattttcaagggtaaacaaactaccagctacaggatagggaagtggtggtggaataagagaacatgatacctggaggaagggaagaaaccacaagcattttcctactgaaaaatagggtgacatgtcagtcaaattctgatcaactggaacttgagtttccagttaaattccatacactaggagggagttttctatcaaaatcctgcagattgaagaagctggtttattagaaccagcctgtcgcttttcaaagctgcttaaaaataagatactgacctcacccctagagatgattcagtgggcctgggtggggccaagaaatccgtggtgttttgtaagcactgctggcgatttctcatggcagtaaagaccacactgagactgcactgattttgattaaagtacataggcttggctgtttttacacagctaactaaatttggactcttaaaattgtgtttgtaatcacagtgtgttacacctttcccagctctcagcagttgtactgcatgatggagcagcgggcccctgggacctgttccctgtgctccctgcctctgagagcccagcttgctctgaagttggactaaaccacttagatgctggggttgccacagcctgctcctggaagcctgcattccagtcaggttgcatccttctggtgctgacagaacccagtggtgaagccaaagcacaggaatgctttaaaaatgaacagtttatgcagaataagggtcaggagtcatgccagaccagaacttgatgctactgtgtcttgtgttaagaatcatttcctggccaggctcggtggctcaggcctgtaatcccagcactttgggaggctgaggcaggtgaatcacttggtcaggagatggagaccattctggctaacatggtgaaaccccgtctctactaaaaatacaaaaaaaaaattagccgggcgtgatggcgggcgcctgcagtcccagctattcgggaggctgaggtagaatggcgtgaacctgggaggcggagcttgcggtgagccaagattgtgccactgctctccagcctgggcgacagagtgagactccgtctcaaaaaaaaaagaatcatttcctttatttttagtttcacgcctgcaaacacaagcattctgttgatcaacggaaatattttgatgtgccatttcttgtctaaacaagtttcatatacagcaccgagggggccacgagaggcagaggcccagacagaaggtgaacatagccttgcagggagacatatgccaggcaggatgaccattgggattgcatcaagtattaatcagttacttaagggcttcctgtcagacagttgaagttcacattccttttacttttcttaattagtccactaggatggtatgcctgttttcaacttaacacatgcatacttgtaaatattttagtatgctacagtaatttgtcatatctttaatatttattgtttgtaaagcagtaaacatttctgtattttagaagtcatggagtaaaatcaaatatttatgataaataattggaagtatgttttagtttgaagattgtcctttttcctatcttgctgcaaggaaaaatggacttctgattaggttttacaattgtgaacttttatgtaaatgttaagtgctttcgaggagaccaaactattattaatatataaaatggccttgcccttaaggagcaaattaaatctcatggagattagactcaaaaggcaataaataatcgagggtttatgcaatgaaatagaatttcagaagagtttggatctcaaagattgtccttcactctcagaaacaggcaagtttcttaaaagcccttatagtcgtgtttttattttaaaaatcgtagcactttatttttgaagtttaaaaagcccataaacttaatgagtctttataatcagacacatggaaatatagaaaaccaaagactgatcttagaatatagagtagagagacatgtttgttattctccactagtgactttagtattttgttatgtgatgttttttaggtgcaccttttctcatgactccttttactttatctaatgtcttcctctttaaagtgtgacccagagaccagtagcatcagcatcacctgagacctgtgaacactgaagctccagctcagacatgttggggaccattttaataagatacctagctgattttttgcacagcaaactttgaaaacccctggtctaaggggtagtatttgtatcacttatggaatataatctcagggaaattaaatctgctcaattgaca

SEQ ID NO: 150689 - DNA, 1183 bp, Homo sapiens
  Payload ID: 9759
  Gene Symbol: MFSD9
  Gene Name: major facilitator superfamily domain containing 9
  ENST ID: ENST00000411991
  CDS Start-End: 69-347
ggggcggggctgggctcccggggtaggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtagacgacgtatgttcaaagagattttgagatttgagcactataaccaagtcccatgccactagtggcaacaggtacttatggagcctctgcaaggagctggctgtgtgtataaaagggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacg

SEQ ID NO: 150690 - DNA, 548 bp, Homo sapiens
  Payload ID: 9759
  Gene Symbol: MFSD9
  Gene Name: major facilitator superfamily domain containing 9
  ENST ID: ENST00000421966
  CDS Start-End: 79-279
gcttccgctcggggcggggctgggctcccggggtaggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggtgagtgcgagcgtgggggctgggagcaagtgctgactgtgttcgggcctggggacccaggcggttcttggagcttccggggagctcccagggagtgggaacccgcagtccgcctggatttgtttggtgtcagcatggttgtgcctttattgagccttcatgtcaagtcccttggagcaagtccaacagttgctggaatagtaggctcctcctatggcattttgcaactcttttctagcacattggtgggctgctggagcgatgtagtgggaagacggtcttccttgctggcatgcattctactc

SEQ ID NO: 150691 - DNA, 2990 bp, Homo sapiens
  Payload ID: 9759
  Gene Symbol: MFSD9
  Gene Name: major facilitator superfamily domain containing 9
  ENST ID: ENST00000438943
  CDS Start-End: 69-347
ggggcggggctgggctcccggggtaggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtagacgacgtatgttcaaagagattttgagatttgagcactataaccaagtcccatgccactagtggcaacaggtacttatggagcctctgcaaggagctggctgtgtgtataaaagggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtttacctggaagtctcttcttcccacctgggctaatcaggttacaattttcaagggtaaacaaactaccagctacaggatagggaagtggtggtggaataagagaacatgatacctggaggaagggaagaaaccacaagcattttcctactgaaaaatagggtgacatgtcagtcaaattctgatcaactggaacttgagtttccagttaaattccatacactaggagggagttttctatcaaaatcctgcagattgaagaagctggtttattagaaccagcctgtcgcttttcaaagctgcttaaaaataagatactgacctcacccctagagatgattcagtgggcctgggtggggccaagaaatccgtggtgttttgtaagcactgctggcgatttctcatggcagtaaagaccacactgagactgcactgattttgattaaagtacataggcttggctgtttttacacagctaactaaatttggactcttaaaattgtgtttgtaatcacagtgtgttacacctttcccagctctcagcagttgtactgcatgatggagcagcgggcccctgggacctgttccctgtgctccctgcctctgagagcccagcttgctctgaagttggactaaaccacttagatgctggggttgccacagcctgctcctggaagcctgcattccagtcaggttgcatccttctggtgctgacagaacccagtggtgaagccaaagcacaggaatgctttaaaaatgaacagtttatgcagaataagggtcaggagtcatgccagaccagaacttgatgctactgtgtcttgtgttaagaatcatttcctggccaggctcggtggctcaggcctgtaatcccagcactttgggaggctgaggcaggtgaatcacttggtcaggagatggagaccattctggctaacatggtgaaaccccgtctctactaaaaatacaaaaaaaaaattagccgggcgtgatggcgggcgcctgcagtcccagctattcgggaggctgaggtagaatggcgtgaacctgggaggcggagcttgcggtgagccaagattgtgccactgctctccagcctgggcgacagagtgagactccgtctcaaaaaaaaaagaa

SEQ ID NO: 150692 - DNA, 576 bp, Homo sapiens
  Payload ID: 9759
  Gene Symbol: MFSD9
  Gene Name: major facilitator superfamily domain containing 9
  ENST ID: ENST00000428085
  CDS Start-End: 1-240
acagttgctggaatagtaggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgc

SEQ ID NO: 150693 - DNA, 2440 bp, Homo sapiens
  Payload ID: 9759
  Gene Symbol: MFSD9
  Gene Name: major facilitator superfamily domain containing 9
  ENST ID: ENST00000437075
  CDS Start-End: 69-365
ggggcggggctgggctcccggggtaggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttgcatggttgtgcctttattgagccttcatgtcaagtcccttggagcaagtccaacagttgctggaatagtagacgacgtatgttcaaagagattttgagatttgagcactataaccaagtcccatgccactagtggcaacaggtacttatggagcctctgcaaggagctggctgtgtgtataaaagggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtttacctggaagtctcttcttcccacctgggctaatcaggttacaattttcaagggtaaacaaactaccagctacaggatagggaagtggtggtggaataagagaacatgatacctggaggaagggaagaaaccacaagcattttcctactgaaaaatagggtgacatgtcagtcaaattctgatcaactggaacttgagtttccagttaaattccatacactaggagggagttttctatcaaaatcctgcagattgaagaagctggtttattagaaccagcctgtcgcttttcaaagctgcttaaaaataagatactgacctcacccctagagatgattcagtgggcctgggtggggccaagaaatccgtggtgttttgtaagcactgctggcgatttctcatggcagtaaagaccacactgagactgcactgattttgattaaagtacataggcttggctgtttttacacagctaactaaatttggactcttaaaattgtgtttgtaatcacagtgtgttacacctttcccagctctcagcagttgtactgcatgatggagcagcgggcccctgggacctgttccctgtgctccctgcctc

SEQ ID NO: 150694 - DNA, 1334 bp, Homo sapiens
  Payload ID: 9760
  Gene Symbol: HLA-A
  Gene Name: major histocompatibility complex, class I, A
  ENST ID: ENST00000376802
  CDS Start-End: 6-905
cgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccttagtataaatttactttctcaaattcttgccatgagaggttgatgagttaattaaaggagaagattcctaaaatttgagagacaaaataaatggaagacatgagaaccttccagagtcca

SEQ ID NO: 150695 - DNA, 1854 bp, Homo sapiens
  Payload ID: 9760
  Gene Symbol: HLA-A
  Gene Name: major histocompatibility complex, class I, A
  ENST ID: ENST00000376806
  CDS Start-End: 310-1425
cgcttcgcacaggagcagaggggtcagggcgaagtcccagggccccaggcgtggctctcagagtctcaggccccgaaggcggtgtatggattggggagtcccagccttggggattccccaactccgcagtttcttttctccctctcccaacctacgtagggtccttcatcctggatactcacgacgcggacccagttctcactcccattgggtgtcgggtttccagagaagccaatcagtgtcgtcgcggtcgctgttctaaagcccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcaggtggagaaggggtgaaggatagaaaaggagggagttacactcaggctgcaagcagtgacagtgcccagggctctgatgtgtccctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccttagtataaatttactttctcaaattcttgccatgagaggttgatgagttaattaaaggagaagattcctaaaatttgagagacaaaataaatggaagacatgagaaccttccagagtcca

SEQ ID NO: 150696 - DNA, 1611 bp, Homo sapiens
  Payload ID: 9760
  Gene Symbol: HLA-A
  Gene Name: major histocompatibility complex, class I, A
  Uniprot ID: P04439
  ENST ID: ENST00000376809
  CDS Start-End: 85-1182
gagaagccaatcagtgtcgtcgcggtcgctgttctaaagcccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtccctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccttagtataaatttactttctcaaattcttgccatgagaggttgatgagttaattaaaggagaagattcctaaaatttgagagacaaaataaatggaagacatgagaaccttccagagtcca

SEQ ID NO: 150697 - DNA, 1334 bp, Homo sapiens
  Payload ID: 9760
  Gene Symbol: HLA-A
  Gene Name: major histocompatibility complex, class I, A
  ENST ID: ENST00000376822
  CDS Start-End: 6-905
cgaggatggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaactttttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150698 - DNA, 1868 bp, Homo sapiens
  Payload ID: 9760
  Gene Symbol: HLA-A
  Gene Name: major histocompatibility complex, class I, A
  Uniprot ID: P18462
  ENST ID: ENST00000383605
  CDS Start-End: 342-1439
aaggggagaggagggcctgaaggatgagaaggacggagggaagggctggagaagcaggaggcgcaactcttcccgattaaaaacaaaaacaacaacaacaaaaatctacacctccattcccagagcaagcttactctctggcaccaaactccatgggatgatttttcttctagaagagtccaggtggacagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctggttctctttggagctgtgatcgctggagctgtggtcgctgctgtgatgtggaggaggaagagctcagatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaactttttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150699 - DNA, 1854 bp, Homo sapiens
  Payload ID: 9760
  Gene Symbol: HLA-A
  Gene Name: major histocompatibility complex, class I, A
  ENST ID: ENST00000383619
  CDS Start-End: 310-1425
cgcttggcacaggagcagaggggtcagggcgaagtcccagggccccaggcgtggctctcagggtctcaggccccgaaggcggtatatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctggttctctttggagctgtgatcgctggagctgtggtcgctgctgtgatgtggaggaggaagagctcaggtggggaagggatgaaggatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaactttttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150700 - DNA, 1868 bp, Homo sapiens
  Payload ID: 9760
  Gene Symbol: HLA-A
  Gene Name: major histocompatibility complex, class I, A
  Uniprot ID: P04439
  ENST ID: ENST00000396634
  CDS Start-End: 342-1439
aaggggagaggagggcctgaaggatgagaaggatggagggaagggctggagaagcaggaggcacaacttttccggattaaaaacaaaaacaacaacaacaaaaatctacacctccattcccagatcaagcttactctctggcaccaaactccatggggtgatttttcttctagaagagtccaggtggacagggtccttcatcctggatactcacgacgcggacccagttctcactcccattgggtgtcgggtttccagagaagccaatcagtgtcgtcgcggtcgctgttctaaagcccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtccctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccttagtataaatttactttctcaaattcttgccatgagaggttgatgagttaattaaaggagaagattcctaaaatttgagagacaaaataaatggaagacatgagaaccttccagagtcca

SEQ ID NO: 150701 - DNA, 1854 bp, Homo sapiens
  Payload ID: 9760
  Gene Symbol: HLA-A
  Gene Name: major histocompatibility complex, class I, A
  ENST ID: ENST00000438861
  CDS Start-End: 310-1425
cgcttggcacagaagcagaggggtcagggcgaagtcccagggccccaggcgtggctctcagggtctcaggccccgaaggcggtgtatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcaggtggggaaggggtgaaggatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150702 - DNA, 1854 bp, Homo sapiens
  Payload ID: 9760
  Gene Symbol: HLA-A
  Gene Name: major histocompatibility complex, class I, A
  ENST ID: ENST00000417978
  CDS Start-End: 310-1425
cgcttcgcacaggagcagaggggtcagggcgaagtcccagggccccaggcgtggctctcagggtctcaggccccgaaggcggtgtatggattggggagtcccagccttggggattccccaactccgcagtttcttttctccctctcccaacctacgtagggtccttcatcctggatactcacgacgcggacccagttctcactcccattgggtgtcgggtttccagagaagccaatcagtgtcgtcgcggtcgctgttctaaagtccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcaggtggagaaggggtgaaggatagaaaaggagggagttacactcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagagcaccccacccccatgtccaccatgaccctcttcccacgctgacctgtgctccctctccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaattaatggaacgcatgagaaccttccagagtcca

SEQ ID NO: 150703 - DNA, 1327 bp, Homo sapiens
  Payload ID: 9760
  Gene Symbol: HLA-A
  Gene Name: major histocompatibility complex, class I, A
  ENST ID: ENST00000413609
  CDS Start-End: 1-898
ggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150704 - DNA, 1334 bp, Homo sapiens
  Payload ID: 9760
  Gene Symbol: HLA-A
  Gene Name: major histocompatibility complex, class I, A
  ENST ID: ENST00000450342
  CDS Start-End: 6-905
cgaggatggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150705 - DNA, 1334 bp, Homo sapiens
  Payload ID: 9760
  Gene Symbol: HLA-A
  Gene Name: major histocompatibility complex, class I, A
  ENST ID: ENST00000453975
  CDS Start-End: 6-905
cgaggatggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150706 - DNA, 1334 bp, Homo sapiens
  Payload ID: 9760
  Gene Symbol: HLA-A
  Gene Name: major histocompatibility complex, class I, A
  ENST ID: ENST00000414592
  CDS Start-End: 6-905
cgaggatggccgtcatggcgccccgaaccctcctcctgctactcttgggggccctggccctgacccagacctgggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagagagcctgcggatcgcgctccgctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150707 - DNA, 1334 bp, Homo sapiens
  Payload ID: 9760
  Gene Symbol: HLA-A
  Gene Name: major histocompatibility complex, class I, A
  ENST ID: ENST00000416096
  CDS Start-End: 6-905
cgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagagcaccccacccccatgtccaccatgaccctcttcccacgctgacctgtgctccctctccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaattaatggaacgcatgagaaccttccagagtcca

SEQ ID NO: 150708 - DNA, 1334 bp, Homo sapiens; identical to SEQ ID NO: 150707
  Payload ID: 9760
  Gene Symbol: HLA-A
  Gene Name: major histocompatibility complex, class I, A
  ENST ID: ENST00000442939
  CDS Start-End: 6-905

SEQ ID NO: 150709 - DNA, 1854 bp, Homo sapiens; identical to SEQ ID NO: 150702
  Payload ID: 9760
  Gene Symbol: HLA-A
  Gene Name: major histocompatibility complex, class I, A
  ENST ID: ENST00000444289
  CDS Start-End: 310-1425

SEQ ID NO: 150710 - DNA, 1868 bp, Homo sapiens
  Payload ID: 9760
  Gene Symbol: HLA-A
  Gene Name: major histocompatibility complex, class I, A
  Uniprot ID: P01892
  ENST ID: ENST00000457879
  CDS Start-End: 342-1439
aaggggacaggagggcctgaaggatgagaaggacggagggaagggctggagaagcaggaggcgcaactcttcccgattaaaaacaaaaacaacaacaacaaaaatctacacctccattcccagagcaagcttactctctggcaccaaactccatgggatgatttttcttctagaagagtccaggtggacagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150711 - DNA, 1525 bp, Homo sapiens
  Payload ID: 9760
  Gene Symbol: HLA-A
  Gene Name: major histocompatibility complex, class I, A
  ENST ID: ENST00000453057
  CDS Start-End: 1-1096
ggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150712 - DNA, 1865 bp, Homo sapiens
  Payload ID: 9760
  Gene Symbol: HLA-A
  Gene Name: major histocompatibility complex, class I, A
  Uniprot ID: P30443
  ENST ID: ENST00000443552
  CDS Start-End: 339-1436
aaggggagaggagggcctgaaggatgagaaggatagagggaagggctggagaagcaggaggcacaacttttccggattaaaaacaaaaacaacaacaaaaatctacacctctattcccagagcaagcttactctctggcaccaaactccatggggtgatttttcttctagaagagtccaggtggacagggtccttcatcctggatactcacgacgcggacccagttctcactcccattgggtgtcgggtttccagagaagccaatcagtgtcgtcgcggtcgctgttctaaagtccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagagcaccccacccccatgtccaccatgaccctcttcccacgctgacctgtgctccctctccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaattaatggaacgcatgagaaccttccagagtcca

SEQ ID NO: 150713 - DNA, 1865 bp, Homo sapiens; identical to SEQ ID NO: 150712
  Payload ID: 9760
  Gene Symbol: HLA-A
  Gene Name: major histocompatibility complex, class I, A
  Uniprot ID: P30443
  ENST ID: ENST00000431930
  CDS Start-End: 339-1436

SEQ ID NO: 150714 - DNA, 1868 bp, Homo sapiens
  Payload ID: 9760
  Gene Symbol: HLA-A
  Gene Name: major histocompatibility complex, class I, A
  Uniprot ID: P30512
  ENST ID: ENST00000456012
  CDS Start-End: 342-1439
aaggggagaggagggcctgaaggatgagaaggatggagggaagggctggagaagcaggaggcgcaacttttcccgattaaaaacaaaaacaacaacaacaaaaatctacacctccattcccagagcaagcttactctctggcaccaaactccatggggtgatttttcttctagaagagtccaggtggacagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctgtgttcgctggagctgtggtcgctgctgtgaggtggaggaggaagagctcagatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150715 - DNA, 1868 bp, Homo sapiens
  Payload ID: 9760
  Gene Symbol: HLA-A
  Gene Name: major histocompatibility complex, class I, A
  Uniprot ID: P30447
  ENST ID: ENST00000454091
  CDS Start-End: 342-1439
aaggggagaggagggcctgaaggatgagaaggatggagggaagggctggagaagcaggaggcgcaacttttcccgattaaaaacaaaaacaacaacaacaaaaatctacacctccattcccagagcaagcttactctctggcaccaaactccatggggtgatttttcttctagaagagtccaggtggacagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagagagcctgcggatcgcgctccgctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctatgttcgctggagctgtggtcgctgctgtgaggtggaggaggaagagctcagatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150716 - DNA, 1543 bp, Homo sapiens
  Payload ID: 9760
  Gene Symbol: HLA-A
  Gene Name: major histocompatibility complex, class I, A
  ENST ID: ENST00000455882
  CDS Start-End: 1-1114
ggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcaggtggggaaggggtgaaggatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150717 - DNA, 1856 bp, Homo sapiens
  Payload ID: 9760
  Gene Symbol: HLA-A
  Gene Name: major histocompatibility complex, class I, A
  ENST ID: ENST00000470780
  CDS Start-End: 310-1338
agcttggcacaggagcagaggggtcagggcgaagtcccagggccccaggcgtggctctcagggtctcaggccccgaaggcggtgtatggattggggagtcccagccttggggattccccaactccgcagtttcttttctccctctgccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctgtgttcgctggagctgtggtcgctgctgtgaggtggaggaggaagagctcaggtggggtgaagggatgaaggatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150718 - DNA, 1611 bp, Homo sapiens
  Payload ID: 9760
  Gene Symbol: HLA-A
  Gene Name: major histocompatibility complex, class I, A
  Uniprot ID: P30443
  ENST ID: ENST00000552193
  CDS Start-End: 85-1182
gagaagccaatcagtgtcgtcgcggtcgctgttctaaagtccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagagcaccccacccccatgtccaccatgaccctcttcccacgctgacctgtgctccctctccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaattaatggaacgcatgagaaccttccagagtcca

SEQ ID NO: 150719 - DNA, 1611 bp, Homo sapiens; identical to SEQ ID NO: 150718
  Payload ID: 9760
  Gene Symbol: HLA-A
  Gene Name: major histocompatibility complex, class I, A
  Uniprot ID: P30443
  ENST ID: ENST00000549869
  CDS Start-End: 85-1182

SEQ ID NO: 150720 - DNA, 1611 bp, Homo sapiens
  Payload ID: 9760
  Gene Symbol: HLA-A
  Gene Name: major histocompatibility complex, class I, A
  Uniprot ID: P01892
  ENST ID: ENST00000547271
  CDS Start-End: 85-1182
gagaagccaatcagtgtcgtcgcggtcgcggttctaaagtccgcacgcacccaccgggactcagattctccccagacgccgaggatggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150721 - DNA, 1611 bp, Homo sapiens
  Payload ID: 9760
  Gene Symbol: HLA-A
  Gene Name: major histocompatibility complex, class I, A
  Uniprot ID: P30450
  ENST ID: ENST00000549224
  CDS Start-End: 85-1182
gagaagccaatcagtgtcgtcgcggtcgcggttctaaagtccgcacgcacccaccgggactcagattctccccagacgccgaggatggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctggttctctttggagctgtgatcgctggagctgtggtcgctgctgtgatgtggaggaggaagagctcagatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaactttttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150722 - DNA, 1611 bp, Homo sapiens
  Payload ID: 9760
  Gene Symbol: HLA-A
  Gene Name: major histocompatibility complex, class I, A
  Uniprot ID: P01892
  ENST ID: ENST00000547522
  CDS Start-End: 85-1182
gagaagccaatcggtgccgccgcggtcccggttctaaagtccccacgcacccaccgggactcagattctccccagacgccgaggatggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150723 - DNA, 5422 bp, Homo sapiens
  Payload ID: 9760
  Gene Symbol: HLA-A
  Gene Name: major histocompatibility complex, class I, A
  ENST ID: ENST00000552498
  CDS Start-End: 1-1185
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtctctcacagcttgtaaaggtgagagcttggagggcctgatgtgtgttgggtgttgggtggaacagtggacacagctgtgctatggggtttctttgcgttggatgtattgagcatgcgatgggctgtttaaggtgtgacccctcactgtgatggatatgaatttgttcatgaatatttttttctatagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagagcaccccacccccatgtccaccatgaccctcttcccacgctgacctgtgctccctctccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaattaatggaacgcatgagaaccttccagagtccacgtgttgcttatgctgatttgttgcaggggaggagagtagatggggctgtgcccagtttctgttccggccaccatgggctttatgtggtcacagctcacctgggtcatctttgctgctccattgtccttggcccttcagtagaaccttgtcccaccaagacctgtgatcacagggagttggatgtcacctagggtggtccctgcatacaaatctccttgtggtatcaagagacaaattttcagacctgtccaggtcttgccttcctcccagggctttttccttaacggtattttcgatttttctccaatctttttaaaggaaccagattgtgacatttgcagagaggaggggtcccatagtttctcatcatggttaactttctgttggaactcctcttctgccctcctactcttcttcctgctctgagttgtagtaatcctagtgctggctccaatccaaactcatagatttataaagcagagtctaatttagattcatatgtggttggaaaattgtacccataaggctagggttattgttcctgaagagaaatatatggttttgtgctgaagtgtgcaggagggttggtgtgggaggagggaggacacacaagcagccctggtgagaaaagcactggcggcatggatgtccacgtgaacttatgttctttagctgccacaaaacagcatttgccctgtggctacattaataaagatatgggctttagaatagggaggtgctctacagtgatcattcattcaactgacatttgttgtctgctagggatatgactgcttttgcatttagaaagcatccttaaagtaaaaacagaaaaatgtctggggttatggtgcatacgttctagatgcaagcttgtccaacccgcggctcgtgggctgcatgtggcccaggacaattttgaatgtgaggacttttttgcttatctgtggtgaacctgagtcctggagtgagtgcacccacctccctcagggtcaggagtgaatgctttaggaaccctccttttcagtgacctacaaaagatagagggcacatttactgtgataacccagagtatcagccaagggggcttgaccttcaaggagtcgtggggaaggttaataaagggtggtgtcccagggtcagaaaagatgggcagacagcaagggcactgcttgatatctatgataagcatgtggaattgaggagcaagcttcagattcagaatccagtgactaaggacatatctatatccctaagagaaagaaccttgggacacgatgatggttatatgctgggacaattccatcagcccttctgcaaaggagcctatagccatttaatcaggagatgggataagtattaacattgggtgtgagctgacattgctgcccagattcctacagcaccattatgtcccccatcacactggggcttacagaagccagggaataaacctagacacattatgccccatggtggaatcaccagttccataaatcctgtcctggttatctccccattctctgagtgcataattggccttgatgcactggcaactggagtcaccccacactgtgtccctagtctggagagtaagggatctcactgtgctgaagcccaaagggaaacatccctcatccaagccaaaccagaagcaatattgtgcctcagggtgggtcttgtggagggtactgcaggtattataggggtggcactgccattacagacctgaacgatgcggggtggtgttgggattgcctgttatctccatataactcagcaatctgtacctgcagaagcctgatatggctaaagaatgaatggaattactccagacttgaccaagtaggagtcctgattgcagctgccatgctggctggatatcactgcctggggagattaataaggcctcaggcacatggcaagcagctgtggatttggtgagtgcattccctcccatttcatttagaagatggatatggaatgattcacattcacatgggatttataatacatttattgatagcttgcatcagggctaccttaactcctcaaccttctataaatatcaccttaagagacctggacgaatcagacatcccacagaatactaaatctcttcatttcattggcaatatcacataaattgggaaggatgaacaacagcaggaaagtacgctgaattccctggcaaaacatgtgcactacagaaggtgaagataaaacttacagagcttcaagagtggccactgcagtgaagtgttatgggtccagtggttaggggcatgcagagctcccccccgccacacacacacacaaagtaaaagacaaacttgcatcttgcatcctcaccagaaggaaggaagcacactacttgatgagcctctctgggttctggcaacaccacattccacatctaagtttattgctttggctgacactctgggtgatataggaggaggccagctttgagtggggcctggactggaaaggacactgcagcagacccaggctgtggtgcagtcagtcaccatccctcacacccctggtgctggaggtggcggtctggggaaagaagcaggatggagctgaaccaagcatcagtgggaaagtcagaatgcagggcctgggatcaggagtaaggccatggagtccacagcagagaaacatgctccatgttagaagcaacttttagcatgttactgtccctgataagatagaatgcttgagcataggacaccaagcaaccatgtgattccaagtgcccgtgtgtattggcttctatgtgacccatagagtcattcactggacaggcccagcggcatctatcatgagacgaaaacggtccatgtcggttgagcctcaattccatgttaacacccacagaaaacacccagtcctgatgtggccctgaataaccaaacaaattgaagacaaattgaagttagccagtctacatcatggatcagcccaggcctgataggaaggacccgtgagtggagcaaccacagtggcagggatgaagctacaaatgagtccagcagcactgtctctccactaccaaggcccacccagctactgcttcctctgaatactctgctcgtgagcattgcagaccaatgataggcaccaatagggcaccatttcttaaagtaactgactagcccctaagtgacaagttgaatagcttgaacaccatccatcctggaaggggcagaagtttatcctcacagggataggctcacagggatgcgatgtggtgtggttttcctctctgctctcagaccctcagtcaacaacactattggcattcctgatccactggctcagaatttcagtacattatctgcctgggggacacacctgttggggaaggggatgaagtgtgggccctgaccatgggatcccctggtcgtatcaccacctgcgcctctcaagtgctgccaggcacacagagtcatggacaggactctacaggcacaactcagtaccagcttggatgaaaccctctgaggaatgggtgccatctttcaggatgtgatgcatgtattgaatcaaagacgtctctaaggcactgttttcagaaggaagaatacgcgggtccaaaaaccaagaagtcaaagcaggtgtgtctcattccttatattcacccccagggtgatttacttataagtaaataaataaatacataacatgaatacttaaataaatttatttatgcatgt

SEQ ID NO: 150724 - DNA, 1611 bp, Homo sapiens
  Payload ID: 9760
  Gene Symbol: HLA-A
  Gene Name: major histocompatibility complex, class I, A
  Uniprot ID: P10314
  ENST ID: ENST00000552493
  CDS Start-End: 85-1182
gagaagccaatcagtgtcgtcgcggtcgcggttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagagagcctgcggatcgcgctccgctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctatgttcgctggagctgtggtcgctgctgtgaggtggaggaggaagagctcagatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150725 - DNA, 5422 bp, Homo sapiens; identical to SEQ ID NO: 150723
  Payload ID: 9760
  Gene Symbol: HLA-A
  Gene Name: major histocompatibility complex, class I, A
  ENST ID: ENST00000551120
  CDS Start-End: 1-1185

SEQ ID NO: 150726 - DNA, 1611 bp, Homo sapiens
  Payload ID: 9760
  Gene Symbol: HLA-A
  Gene Name: major histocompatibility complex, class I, A
  ENST ID: ENST00000550728
  CDS Start-End: 85-1182
gagaagccaatcagtgtcgtcgcggtcgcggttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctgtgttcgctggagctgtggtcgctgctgtgaggtggaggaggaagagctcagatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150727 - DNA, 1494 bp, Homo sapiens
  Payload ID: 9760
  Gene Symbol: HLA-A
  Gene Name: major histocompatibility complex, class I, A
  ENST ID: ENST00000612644
  CDS Start-End: 85-1065
gagaagccaatcagtgtcgtcgcggtcgcggttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagagagcctgcggatcgcgctccgctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 150728 - DNA, 1550 bp, Homo sapiens
  Payload ID: 9760
  Gene Symbol: HLA-A
  Gene Name: major histocompatibility complex, class I, A
  ENST ID: ENST00000611149
  CDS Start-End: 144-1160
tttcctggatactcaggaagcgggcacagttctcattcccactaggtgtcgggtttctagagaagccaatcggtgccgccgcggtcccggttctaaagtccccacgcacccaccgggactcagattctccccagacgccgaggatggtgctcatggcgccccgaaccctcctcctgctgctctcaggggccctggccctgacccagacctgggcgcgctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaatgtgacttcaagggcctctgtcttctctttctgccaagtccctttgtgacttcaagaaccctgacttctctttctgcaaagaccagcccacacccgtgtccaccatgaccctgttccccacactgacctacattccttccccgatcacctttcctgttccagagaagtggtgctgggatgtctccatctctgtctcaacttcatggtgcactgagctgtaacttcttacttccctattaaaattagaatctgagtataaatttacttttttcaaattatttccatgacgggttgatgggttaattaaaggagaagattcctaaaatttgagagacaaaataaatggaagacatgagaacctt

SEQ ID NO: 150729 - DNA, 5436 bp, Homo sapiens
  Payload ID: 9760
  Gene Symbol: HLA-A
  Gene Name: major histocompatibility complex, class I, A
  ENST ID: ENST00000616730
  CDS Start-End: 1-1185
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctggttctctttggagctgtgatcgctggagctgtggtcgctgctgtgatgtggaggaggaagagctcagatagaaaaggagggagctactctcaggctgcaagcagtgacagtgcccagggctctgatatgtctctcacagcttgtaaaggtgagagcctggagggcctgatgtgtgttgggtgttgggcggaacagtggacgcagctgtgctatggggtttctttgcattggatgtattgagcatgcgatgggctgtttaaagtgtgactcctcactgtgacagatacgaatttgttcatgaatatttttttctatagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaactttttccttccctattaaaattagaacctgagtataaatttactttctcaaattcttgccatgagaggttgatgagttaattaaaggagaagattcctaaaatttgagagacaaaataaatggaacacatgagaaccttccagagtccacgtgttgcttatgctgatttgttgcaggggaggagagtagatggggctgtgcccagtttctgttccggccaccatgggctttatgtggtcactgcttggctgggtcatctttgctgctccattgtccttggcccttcagtagaaacttgtcccaccaagacctgtgatcacagggagttggatgtcacctacggtggtccctgcatacaaatctccttgtggtatcaagagacaaattttcagacctgtccaggtcttgccttcctcccagggctttttcctcaattgtatttttgatttttctccagtctttttaaaggaaccagattgtgacatttgcagagaggaggggtcccatagtttctcatcatgattaactttctgttggaactcctcttctgccctcctactcttcttcctgctctgagttgtagtaatcctaatgctggctccaatccaaactcatagatttataaagcagagtctaatttagattcatatgtggttggaaaattgtacccataaggctagggttattgttcctgaagagaaatatatggttttgtgctgaagtgtgcaggagggttggtgtgggaggagggaggacacacaagcagccctggtgagaaaagcactggcggcatggatgtccatgtgaacttatgttctttagctgccacaaaacagcatttgccctgtggctacattaataaaggtatgggctttagaatagggaggtgctctacagtgatcattcattcaactgacatttgttgtctgctagggatatgactgcttttgcatttagaaagcatccttaaagtaaaaacagaaaaatttctggggttatggtgcatacgttctagatgcaggcttgtccaacccgtggctcgtgggctgcatgtggcccaggacaattttgaatgtgaggacttttttgcttatctgtggtgcacctgagtcctggagtgagtgcacccacctccctcagggtcaggagtgaatgctttaggaaccctccttttcagtgacctgccaaagataaagggcacatttactgtgataacccagagtatcagccaagggggcttgaccttcaaggagttgtggggaaggttaataaagggtggtgtcccagggtcagaaaagatgggcagacagcaagggcacttcttgatatctatgataagcatgtggaattgagtagcaagcttcagattcagaatccagtgactaaggacatatctgtatccctaagagaaagaaccttgggacacgatgatggttacatgctgggacaattccatcagcccttctgcaaaggagcctatagccatttaatcaggagatgggataagtattaacactgggtgtgagctgacattgctgcccagattcccacagcaccattatgtcccccatcacactggggcttacagaggccagggaataaacctagacacattatgccccatggtggaatcaccagttccataaatcctgtcctgattatctccccattctcttagtgcataattggccttgatgcactggcaactggagtcaccccacactgtgtccctagtctggagagtaagggatctcattgtgctgaagcccaaagggaaacatccctcatccaagccaaaccagaagcaatattgtgccccagggtgggtcttgtggagggtactgcaggtattataggggtggcactgccattacagacctgaacaatgcggggtggtgttgggattgcctgttatctccatataactcagcaatctgtacctgcagaagcctgatacggctaaagaatgaatggaattactccagacttgaccaagtaggagtcctgattgcagctgccatgctggctggatatcactgcctggggagattaataaggcctcaggcacatggcaagcagctgtggatttggtgagtgcattccctcccatttcatttagaagatggatatggaatgattcacattcacatgggatttataatacatttattgatagcttgcatcagggctaccttaactcctcaaccttctataaataccaccttaagagacctggacgaatcagacatctcacagaatactaaatctcttcatttcattggcaatatcacataaattgggaaggatgaacaagagcaggaaagtacgctgaattccctggcaaaacatgtgcactacagaaggtgaagataaaccttacagagcttcaagagtggccactgcagtgaagtgttacgggtccagtggttaggggcatgcagagctccccccaccccccacccccgcccccccgtgccaaagtaaaagacaaacttgcatcttgcatcctcaccagaaggaaggaagtacactacttggtgagcctctctgggttctggcaacaccacattccacatctaagtatattgctttggctgacactctgggtgatataggaggaggccagctttgagtggggcctggactggaaaggacactgcagcagacccaggctgtggtgcagtcagtcaccatccctcagacccctggtgctggaggtggcggtctgcggaaagaagcaggatggagctgaaccaagcatcagtgggaaagtcagaatgcagggcctgggatcaggagtaaggccatggagtccacagcagagaaacatgctccatgttagaagcaacttttagcatgttactggccctgataagatagaatgcttgagcataggacaccaagcaaccatgtgattccaagtgcccgtgtgtattggcttctatgtgacccatagagtcattcgttggacaggcccaacggcatctatcatgagacgaaaatggtccatgtcggttgagcctcaattccatgttaacacccacagaaaacacccagtcctgatgtggccctgaataaccaaacaaattgaagacaaattgaagttagccagtctgcatcatggatcagcccaggcctgataggaaggacccgtgagtggagcaaccacagtggcagggatgaagctacaaatgagtccagcagcactgtctctccactaccaaggcccacccagctactgcttcctctgaatactctgctcgtgagcattgcagaccaatgataggcaccgatagggcactatttcttaaagtaactgactagcccctaagtgacaagttgaatagcttgaacaccatccatcctggaaggggcagaagttcatcctcacagggataggctcacagggattcgatgtggtgtggttttcctctctgctctcagaccctcagtcaacaacactattggcattcctgatccactggctcagaatttcagtacattatctgcctgggggacacacctcttggggaaggggatgaagtatgggccctgaccatgggatcccctggtcatatcaccacctgcgcctctcaagtgctgccaggcacacagagtcatggacaggactctacaggcacaactcagtaccagcttggatgaaatcctctgaggaatgggtgccatctttcaggatgtgatgcatgtattgaatcaaagacatctctaaggcactgttttcagaaggaagaatacgtgggtccaaaaaccaagaagtcaaagcaggtgtgtctcattccttatattcacccccagggtgatttacttataagtaaataaataaatacataaataacatgagtacacaaataaatttatttatgcatgt

SEQ ID NO: 150730 - DNA, 1561 bp, Homo sapiens
  Payload ID: 9761
  Gene Symbol: HLA-B
  Gene Name: major histocompatibility complex, class I, B
  Uniprot ID: P30466
  ENST ID: ENST00000359635
  CDS Start-End: 44-1132
ccccacgcacccacccggactcagaatctcctcagacgccgagatgcgggtcacggcgccccgaaccctcctcctgctgctctggggggcagtggccctgaccgagacctgggctggctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaaagcctgagacagctgtcttgtgagggaccgagatgcaggatttcttcacgcctcccctttgtgacttcaagagcctctggcatctctttctgcaaaggcacctgaatgtgtctgcgtccctgttagcataatgtgaggaggtggagagacagctcacccccgtgtccaccgtgacccctgttcccatgctgacctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 150731 - DNA, 1605 bp, Homo sapiens
  Payload ID: 9761
  Gene Symbol: HLA-B
  Gene Name: major histocompatibility complex, class I, B
  Uniprot ID: P30464
  ENST ID: ENST00000450871
  CDS Start-End: 88-1176
tctagagaagccaatcagtgtcgccggggtcccagttctaaagtccccacgcacccacccggactcaaaatctcctcagacgccgagatgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaaagcctgagacagctgtcttgtgagggaccgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgatctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgaaagagcaaataaagacctgagaaccttccagaa

SEQ ID NO: 150732 - DNA, 1154 bp, Homo sapiens
  Payload ID: 9761
  Gene Symbol: HLA-B
  Gene Name: major histocompatibility complex, class I, B
  ENST ID: ENST00000416726
  CDS Start-End: 1-725
ggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcagggcattttcttcccacaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttacgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 150733 - DNA, 864 bp, Homo sapiens
  Payload ID: 9761
  Gene Symbol: HLA-B
  Gene Name: major histocompatibility complex, class I, B
  ENST ID: ENST00000437866
  CDS Start-End: 127-864
cccggactcaaaatctcctcagacgccgagatgcgggtcacggcgccccgaaccgtcctcctgctgctctcgggagccctggccctgaccgagacctgggccggtgagtgcggggtcggcagggaaatggcctctgtggggaggagcgaggggaccgcaggcgggggcgcaggacccggggagccgcgccgggaggagggtcgggcgggtctcagcccctcctcgcccccaggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcg

SEQ ID NO: 150734 - DNA, 738 bp, Homo sapiens
  Payload ID: 9761
  Gene Symbol: HLA-B
  Gene Name: major histocompatibility complex, class I, B
  ENST ID: ENST00000445610
  CDS Start-End: 1-738
atggcctctgtggggaggagagaggggaccgcaggcgggggcgcaggacccggggagccgcgccgggaggagggtcgggcgggtctcagcccctcctcgcccccaggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcg

SEQ ID NO: 150735 - DNA, 1154 bp, Homo sapiens
  Payload ID: 9761
  Gene Symbol: HLA-B
  Gene Name: major histocompatibility complex, class I, B
  ENST ID: ENST00000437265
  CDS Start-End: 1-725
ggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcagggcattttcttcccacaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccccgtgtccaccgtgacccctgttcccatgctgacttgtgtttcctccccagtcatctttcctgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 150736 - DNA, 1547 bp, Homo sapiens
  Payload ID: 9761
  Gene Symbol: HLA-B
  Gene Name: major histocompatibility complex, class I, B
  Uniprot ID: P01889
  ENST ID: ENST00000412585
  CDS Start-End: 30-1118
ccggactcagagtctcctcagacgccgagatgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttacgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 150737 - DNA, 863 bp, Homo sapiens
  Payload ID: 9761
  Gene Symbol: HLA-B
  Gene Name: major histocompatibility complex, class I, B
  ENST ID: ENST00000445222
  CDS Start-End: 126-863
cccggactcagagtctcctcagacgccgagatgctggtcatggcgccccgaaccgtcctcctgctgctctcggcggccctggccctgaccgagacctgggccggtgagtgcgggtcgggagggaaatggcctctgccgggaggagcgaggggaccgcaggcgggggcgcaggacctgaggagccgcgccgggaggagggtcgggcgggtctcagcccctcctcgcccccaggctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcg

SEQ ID NO: 150738 - DNA, 1605 bp, Homo sapiens
  Payload ID: 9761
  Gene Symbol: HLA-B
  Gene Name: major histocompatibility complex, class I, B
  Uniprot ID: P30460
  ENST ID: ENST00000425848
  CDS Start-End: 88-1176
tctagagaagccaatcagcgtcgccggggtcccagttctaaagtccccacgcacccacccggactcagagtctcctcagacgccgagatgctggtcatggcgccccgaaccgtcctcctgctgctctcggcggccctggccctgaccgagacctgggccggctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttacgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 150739 - DNA, 1154 bp, Homo sapiens
  Payload ID: 9761
  Gene Symbol: HLA-B
  Gene Name: major histocompatibility complex, class I, B
  ENST ID: ENST00000425798
  CDS Start-End: 1-725
ggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggacattttcttcccacaggtggaaaaggagggagctactctcaggctgcgtccagcgacagtgcccagggctctgatgtgtctctcacagcttgaaaagcctgagacagctgtcttgtgagggaccgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgatctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgaaagagcaaataaagacctgagaaccttccagaa

SEQ ID NO: 150740 - DNA, 1154 bp, Homo sapiens
  Payload ID: 9761
  Gene Symbol: HLA-B
  Gene Name: major histocompatibility complex, class I, B
  ENST ID: ENST00000436729
  CDS Start-End: 1-725
ggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcagggcattttcttcccacaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccccgtgtccaccgtgacccctgttcccatgctgacttgtgtttcctccccagtcatctttcctgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 150741 - DNA, 1605 bp, Homo sapiens
  Payload ID: 9761
  Gene Symbol: HLA-B
  Gene Name: major histocompatibility complex, class I, B
  Uniprot ID: P30461
  ENST ID: ENST00000435618
  CDS Start-End: 88-1176
tctagagaagccaatcagtgtcgccggggtcccagttctaaagtccccacgcacccacccggactcagaatctcctcagacgccgagatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccccgtgtccaccgtgacccctgttcccatgctgacttgtgtttcctccccagtcatctttcctgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 150742 - DNA, 1589 bp, Homo sapiens
  Payload ID: 9761
  Gene Symbol: HLA-B
  Gene Name: major histocompatibility complex, class I, B
  Uniprot ID: P30481
  ENST ID: ENST00000421349
  CDS Start-End: 72-1160
agtgtcgccggggtcccagttctaaagtccccacgcacccacccggactcagaatctcctcagacgccgagatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccccgtgtccaccgtgacccctgttcccatgctgacttgtgtttcctccccagtcatctttcctgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 150743 - DNA, 863 bp, Homo sapiens
  Payload ID: 9761
  Gene Symbol: HLA-B
  Gene Name: major histocompatibility complex, class I, B
  ENST ID: ENST00000434333
  CDS Start-End: 126-863
cccggactcagagtctcctcagacgccgagatgctggtcatggcgccccgaaccgtcctcctgctgctctcggcggccctggccctgaccgagacctgggccggtgagtgcgggtcgggagggaaatggcctctgccgggaggagcgaggggaccgcaggcgggggcgcaggacctgaggagccgcgccgggaggagggtcgggcgggtctcagcccctcctcacccccaggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcg

SEQ ID NO: 150744 - DNA, 1154 bp, Homo sapiens
  Payload ID: 9761
  Gene Symbol: HLA-B
  Gene Name: major histocompatibility complex, class I, B
  ENST ID: ENST00000418147
  CDS Start-End: 1-725
ggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggacattttcttcccacaggtggaaaaggagggagctactctcaggctgcgtccagcgacagtgcccagggctctgatgtgtctctcacagcttgaaaagcctgagacagctgtcttgtgagggaccgagatgcaggatttcttcacgcctcccctttgtgacttcaagagcctctggcatctctttctgcaaaggcacctgaatgtgtctgcgtccctgttagcataatgtgaggaggtggagagacagctcacccccgtgtccaccgtgacccctgttcccatgctgacctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 150745 - DNA, 820 bp, Homo sapiens
  Payload ID: 9761
  Gene Symbol: HLA-B
  Gene Name: major histocompatibility complex, class I, B
  ENST ID: ENST00000430299
  CDS Start-End: 83-820
gccccgaaccctcctcctgctgctctggggggcagtggccctgaccgagacctgggccggtgagtgcggggtcgggagggaaatggcctctgtggggaggagagaggggaccgcaggcgggggcgcaggacccggggagccgcgccgggaggagggtcgggcgggtctcagcccctcctcgcccccaggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcg

SEQ ID NO: 150746 - DNA, 1005 bp, Homo sapiens
  Payload ID: 9761
  Gene Symbol: HLA-B
  Gene Name: major histocompatibility complex, class I, B
  ENST ID: ENST00000479203
  CDS Start-End: 3-677
agatgcgggtcacggcgccccgaaccctcctcctgctgctctggggggcagtggccctgaccgagacctgggctggctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcggatcaggagcagaagtctctgttccccgctcagagactcgaactttccaatgaatagattatcccagaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttg

SEQ ID NO: 150747 - DNA, 1008 bp, Homo sapiens
  Payload ID: 9761
  Gene Symbol: HLA-B
  Gene Name: major histocompatibility complex, class I, B
  ENST ID: ENST00000498484
  CDS Start-End: 3-677
agatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggatcaggagcagaagtccctgttccccgctcagagactcgaactttccaatgaataggagattatcccagaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttg

SEQ ID NO: 150748 - DNA, 1008 bp, Homo sapiens
  Payload ID: 9761
  Gene Symbol: HLA-B
  Gene Name: major histocompatibility complex, class I, B
  ENST ID: ENST00000471639
  CDS Start-End: 3-677
agatgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggatcaggagcagaagtccctgttccccgctcagagactcgaactttccaatgaataggagattatcccagaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttg

SEQ ID NO: 150749 - DNA, 1008 bp, Homo sapiens
  Payload ID: 9761
  Gene Symbol: HLA-B
  Gene Name: major histocompatibility complex, class I, B
  ENST ID: ENST00000481283
  CDS Start-End: 3-677
agatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcggatcaggagcagaagtccctgttccccgctcagagactcgaactttccaatgaataggagattatcccagaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttg

SEQ ID NO: 150750 - DNA, 1008 bp, Homo sapiens
  Payload ID: 9761
  Gene Symbol: HLA-B
  Gene Name: major histocompatibility complex, class I, B
  ENST ID: ENST00000461583
  CDS Start-End: 3-677
agatgctggtcatggcgccccgaaccgtcctcctgctgctctcggcggccctggccctgaccgagacctgggccggctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggatcaggagcagaagtccctgttccccgctcagagactcgaactttccaatgaataggagattatcccagaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttg

SEQ ID NO: 150751 - DNA, 1536 bp, Homo sapiens
  Payload ID: 9762
  Gene Symbol: HLA-C
  Gene Name: major histocompatibility complex, class I, C
  Uniprot ID: P10321
  ENST ID: ENST00000376228
  CDS Start-End: 16-1116
tccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcacctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 150752 - DNA, 1538 bp, Homo sapiens
  Payload ID: 9762
  Gene Symbol: HLA-C
  Gene Name: major histocompatibility complex, class I, C
  ENST ID: ENST00000376237
  CDS Start-End: 35-430
cccacccggactcacattctccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcacctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 150753 - DNA, 1552 bp, Homo sapiens
  Payload ID: 9762
  Gene Symbol: HLA-C
  Gene Name: major histocompatibility complex, class I, C
  ENST ID: ENST00000383323
  CDS Start-End: 16-1134
tccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcagggcattttcttcccacaggtggaaaaggagggagctgctctcaggctgcgtccagcaacagtgcccagggctctgatgagtctctcatcgcttgtaaagcctgagacagctgcctgtgtgggactgagatgcaggatttcttcacacctttcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 150754 - DNA, 1554 bp, Homo sapiens
  Payload ID: 9762
  Gene Symbol: HLA-C
  Gene Name: major histocompatibility complex, class I, C
  ENST ID: ENST00000383329
  CDS Start-End: 16-1134
tccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcagggcattttcttcccacaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcacctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 150755 - DNA, 1530 bp, Homo sapiens
  Payload ID: 9762
  Gene Symbol: HLA-C
  Gene Name: major histocompatibility complex, class I, C
  ENST ID: ENST00000383483
  CDS Start-End: 16-1209
tccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtagggaaggggtgaggagtggggtctggccagcaacagtgcccagggctctgatgagtctctcatcgcttgtaaagcctgagacagctgcctgtgtgggactgagatgcaggatttcttcacacctttcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 150756 - DNA, 1552 bp, Homo sapiens; identical to SEQ ID NO: 150753
  Payload ID: 9762
  Gene Symbol: HLA-C
  Gene Name: major histocompatibility complex, class I, C
  ENST ID: ENST00000383487
  CDS Start-End: 16-1134

SEQ ID NO: 150757 - DNA, 1599 bp, Homo sapiens
  Payload ID: 9762
  Gene Symbol: HLA-C
  Gene Name: major histocompatibility complex, class I, C
  Uniprot ID: P30504
  ENST ID: ENST00000400341
  CDS Start-End: 81-1181
aagccaatcagcgtctccgcagtcccggttctaaagtccccagtcacccacccggactcggattctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctttcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 150758 - DNA, 1578 bp, Homo sapiens
  Payload ID: 9762
  Gene Symbol: HLA-C
  Gene Name: major histocompatibility complex, class I, C
  Uniprot ID: P30504
  ENST ID: ENST00000400394
  CDS Start-End: 60-1160
gtcccggttctaaagtccccagtcacccacccggactcggattctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctttcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 150759 - DNA, 1530 bp, Homo sapiens; identical to SEQ ID NO: 150755
  Payload ID: 9762
  Gene Symbol: HLA-C
  Gene Name: major histocompatibility complex, class I, C
  ENST ID: ENST00000400395
  CDS Start-End: 16-1209

SEQ ID NO: 150760 - DNA, 1552 bp, Homo sapiens
  Payload ID: 9762
  Gene Symbol: HLA-C
  Gene Name: major histocompatibility complex, class I, C
  ENST ID: ENST00000453809
  CDS Start-End: 16-1134
tccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcagggcattttcttcccacaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgcgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaatccctggaagttgagagagcaaataaagacctgagaaccttccagaa

SEQ ID NO: 150761 - DNA, 1452 bp, Homo sapiens
  Payload ID: 9762
  Gene Symbol: HLA-C
  Gene Name: major histocompatibility complex, class I, C
  ENST ID: ENST00000422726
  CDS Start-End: 23-1129
cacattctccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcagctgcctgtgtgggactgagatgcaggatttcttcacacctctcctttgtgacttcaagagcctctggcatctctttctgcaaaggcgtctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 150762 - DNA, 1530 bp, Homo sapiens
  Payload ID: 9762
  Gene Symbol: HLA-C
  Gene Name: major histocompatibility complex, class I, C
  ENST ID: ENST00000414249
  CDS Start-End: 16-1209
tccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcaggtagggaaggggtgaggagtggggtctggccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgcgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaatccctggaagttgagagagcaaataaagacctgagaaccttccagaa

SEQ ID NO: 150763 - DNA, 1579 bp, Homo sapiens
  Payload ID: 9762
  Gene Symbol: HLA-C
  Gene Name: major histocompatibility complex, class I, C
  Uniprot ID: P04222
  ENST ID: ENST00000457903
  CDS Start-End: 60-1160
gtcccggttctgaagtccccagtcacccacccggactcagattctccccagacgccgagatgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcgctgagctgcaacttcttacttccctaatgaagttaggaacctgaatataaatttgttttctcaaatatttgctatgaagggttgatggattaattaaataagtcaattcctggaagttgagagagcaaataaagacctgagaactttccagaa

SEQ ID NO: 150764 - DNA, 1460 bp, Homo sapiens
  Payload ID: 9762
  Gene Symbol: HLA-C
  Gene Name: major histocompatibility complex, class I, C
  ENST ID: ENST00000419590
  CDS Start-End: 23-1042
cggattctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcagcctgagacagctgcctgtgtgggactgagatgcaggatttcttcacacctctcctttgtgacttcaagagcctctggcatctctttctgcaaaggcatctgaatgcgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaatccctggaagttgagagagcaaataaagacctgagaaccttccagaa

SEQ ID NO: 150765 - DNA, 782 bp, Homo sapiens
  Payload ID: 9762
  Gene Symbol: HLA-C
  Gene Name: major histocompatibility complex, class I, C
  ENST ID: ENST00000454033
  CDS Start-End: 1-782
gcgggtcatggcgccccgaaccctcatcctgctgctctcgggagccctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccagcaggagatggaaccttccagaagtgggcagctgtggtggtgccttctggagaagagcagagatacacgtgccatgtgcagcacgaggggctgccagagcccctcaccctgaga

SEQ ID NO: 150766 - DNA, 1578 bp, Homo sapiens
  Payload ID: 9762
  Gene Symbol: HLA-C
  Gene Name: major histocompatibility complex, class I, C
  Uniprot ID: P30499
  ENST ID: ENST00000438171
  CDS Start-End: 60-1160
gtcccggttctaaagtccccagtcacccacccggactcggattctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgcgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaatccctggaagttgagagagcaaataaagacctgagaaccttccagaa

SEQ ID NO: 150767 - DNA, 1450 bp, Homo sapiens
  Payload ID: 9762
  Gene Symbol: HLA-C
  Gene Name: major histocompatibility complex, class I, C
  ENST ID: ENST00000456487
  CDS Start-End: 23-1129
cggattctccccagacgccgagatgcgggtcatggcgccccgaaccctcatcctgctgctctcgggagccctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 150768 - DNA, 1530 bp, Homo sapiens
  Payload ID: 9762
  Gene Symbol: HLA-C
  Gene Name: major histocompatibility complex, class I, C
  ENST ID: ENST00000422921
  CDS Start-End: 16-1209
tccccagacgccgagatgcgggtcatggcgccccgaaccctcatcctgctgctctcgggagccctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtagggaaggggtgaggagtggggtctggccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 150769 - DNA, 1450 bp, Homo sapiens
  Payload ID: 9762
  Gene Symbol: HLA-C
  Gene Name: major histocompatibility complex, class I, C
  ENST ID: ENST00000434884
  CDS Start-End: 23-1129
cggattctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcagctgcctgtgtgggactgagatgcaggatttcttcacacctttcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 150770 - DNA, 782 bp, Homo sapiens
  Payload ID: 9762
  Gene Symbol: HLA-C
  Gene Name: major histocompatibility complex, class I, C
  ENST ID: ENST00000415537
  CDS Start-End: 1-782
gcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccagcaggagatggaaccttccagaagtgggcagctgtggtggtgccttctggacaagagcagagatacacgtgccatatgcagcacgaggggctgcaagagcccctcaccctgagc

SEQ ID NO: 150771 - DNA, 1447 bp, Homo sapiens
  Payload ID: 9762
  Gene Symbol: HLA-C
  Gene Name: major histocompatibility complex, class I, C
  ENST ID: ENST00000458668
  CDS Start-End: 20-1126
attctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcagctgcctgtgtgggactgagatgcaggatttcttcacacctttcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 150772 - DNA, 1554 bp, Homo sapiens
  Payload ID: 9762
  Gene Symbol: HLA-C
  Gene Name: major histocompatibility complex, class I, C
  ENST ID: ENST00000423509
  CDS Start-End: 16-1134
tccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcagggcattttcttcccacaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcgtctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 150773 - DNA, 1552 bp, Homo sapiens
  Payload ID: 9762
  Gene Symbol: HLA-C
  Gene Name: major histocompatibility complex, class I, C
  ENST ID: ENST00000458192
  CDS Start-End: 16-1134
tccccagacgccgagatgcgggtcatggcgccccgaaccctcatcctgctgctctcgggagccctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcagggcattttcttcccacaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 150774 - DNA, 782 bp, Homo sapiens
  Payload ID: 9762
  Gene Symbol: HLA-C
  Gene Name: major histocompatibility complex, class I, C
  ENST ID: ENST00000457806
  CDS Start-End: 1-782
gcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccagcaggagatggaaccttccagaagtgggcagctgtggtggtgccttctggacaagagcagagatacacgtgccatatgcagcacgaggggctgcaagagcccctcaccctgagc

SEQ ID NO: 150775 - DNA, 1553 bp, Homo sapiens
  Payload ID: 9762
  Gene Symbol: HLA-C
  Gene Name: major histocompatibility complex, class I, C
  ENST ID: ENST00000419135
  CDS Start-End: 16-1134
tccccagacgccgagatgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcagggcattttcttcccacaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcgctgagctgcaacttcttacttccctaatgaagttaggaacctgaatataaatttgttttctcaaatatttgctatgaagggttgatggattaattaaataagtcaattcctggaagttgagagagcaaataaagacctgagaactttccagaa

SEQ ID NO: 150776 - DNA, 782 bp, Homo sapiens
  Payload ID: 9762
  Gene Symbol: HLA-C
  Gene Name: major histocompatibility complex, class I, C
  ENST ID: ENST00000437368
  CDS Start-End: 1-782
gcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccagcaggagatggaaccttccagaagtgggcagctgtggtggtgccttctggagaagagcagagatacacgtgccatgtgcagcacgaggggctgccggagcccctcaccctgaga

SEQ ID NO: 150777 - DNA, 1578 bp, Homo sapiens
  Payload ID: 9762
  Gene Symbol: HLA-C
  Gene Name: major histocompatibility complex, class I, C
  Uniprot ID: P30501
  ENST ID: ENST00000420206
  CDS Start-End: 60-1160
gtcccggttctaaagtccccagtcacccacccggactcggattctccccagacgccgagatgcgggtcatggcgccccgaaccctcatcctgctgctctcgggagccctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 150778 - DNA, 782 bp, Homo sapiens
  Payload ID: 9762
  Gene Symbol: HLA-C
  Gene Name: major histocompatibility complex, class I, C
  ENST ID: ENST00000448362
  CDS Start-End: 1-782
gcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccagcaggagatggaaccttccagaagtgggcagctgtggtggtgccttctggagaagagcagagatacacgtgccatgtgcagcacgaggggctgccagagcccctcaccctgaga

SEQ ID NO: 150779 - DNA, 782 bp, Homo sapiens; identical to SEQ ID NO: 150778
  Payload ID: 9762
  Gene Symbol: HLA-C
  Gene Name: major histocompatibility complex, class I, C
  ENST ID: ENST00000449884
  CDS Start-End: 1-782

SEQ ID NO: 150780 - DNA, 782 bp, Homo sapiens
  Payload ID: 9762
  Gene Symbol: HLA-C
  Gene Name: major histocompatibility complex, class I, C
  ENST ID: ENST00000445075
  CDS Start-End: 1-782
gcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccagcaggagatggaaccttccagaagtgggcagctgtggtggtgccttctggagaagagcagagatacacgtgccatgtgcagcacgaggggctgccggagcccctcaccctgaga

SEQ ID NO: 150781 - DNA, 1451 bp, Homo sapiens
  Payload ID: 9762
  Gene Symbol: HLA-C
  Gene Name: major histocompatibility complex, class I, C
  ENST ID: ENST00000429840
  CDS Start-End: 23-1129
cagattctccccagacgccgagatgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcgctgagctgcaacttcttacttccctaatgaagttaggaacctgaatataaatttgttttctcaaatatttgctatgaagggttgatggattaattaaataagtcaattcctggaagttgagagagcaaataaagacctgagaactttccagaa

SEQ ID NO: 150782 - DNA, 1532 bp, Homo sapiens
  Payload ID: 9762
  Gene Symbol: HLA-C
  Gene Name: major histocompatibility complex, class I, C
  ENST ID: ENST00000430940
  CDS Start-End: 16-1209
tccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtagggaaggggtgaagagcggggtctgggcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcgtctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 150783 - DNA, 1580 bp, Homo sapiens
  Payload ID: 9762
  Gene Symbol: HLA-C
  Gene Name: major histocompatibility complex, class I, C
  ENST ID: ENST00000424832
  CDS Start-End: 60-1160
gtcccggttctaaagtccccagtcacccacccggactcacattctccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcgtctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 150784 - DNA, 1502 bp, Homo sapiens
  Payload ID: 9762
  Gene Symbol: HLA-C
  Gene Name: major histocompatibility complex, class I, C
  ENST ID: ENST00000433153
  CDS Start-End: 16-1083
tccccagacgccgagatgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcagccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcgctgagctgcaacttcttacttccctaatgaagttaggaacctgaatataaatttgttttctcaaatatttgctatgaagggttgatggattaattaaataagtcaattcctggaagttgagagagcaaataaagacctgagaactttccagaa

SEQ ID NO: 150785 - DNA, 1536 bp, Homo sapiens
  Payload ID: 9762
  Gene Symbol: HLA-C
  Gene Name: major histocompatibility complex, class I, C
  ENST ID: ENST00000485321
  CDS Start-End: 35-430
cccacccggactcggattctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctttcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 150786 - DNA, 1536 bp, Homo sapiens
  Payload ID: 9762
  Gene Symbol: HLA-C
  Gene Name: major histocompatibility complex, class I, C
  ENST ID: ENST00000488273
  CDS Start-End: 35-430
cccacccggactcggattctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgcgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaatccctggaagttgagagagcaaataaagacctgagaaccttccagaa

SEQ ID NO: 150787 - DNA, 1536 bp, Homo sapiens
  Payload ID: 9762
  Gene Symbol: HLA-C
  Gene Name: major histocompatibility complex, class I, C
  ENST ID: ENST00000479595
  CDS Start-End: 35-430
cccacccggactcggattctccccagacgccgagatgcgggtcatggcgccccgaaccctcatcctgctgctctcgggagccctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 150788 - DNA, 1537 bp, Homo sapiens
  Payload ID: 9762
  Gene Symbol: HLA-C
  Gene Name: major histocompatibility complex, class I, C
  ENST ID: ENST00000491984
  CDS Start-End: 35-430
cccacccggactcagattctccccagacgccgagatgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcgctgagctgcaacttcttacttccctaatgaagttaggaacctgaatataaatttgttttctcaaatatttgctatgaagggttgatggattaattaaataagtcaattcctggaagttgagagagcaaataaagacctgagaactttccagaa

SEQ ID NO: 150789 - DNA, 966 bp, Homo sapiens
  Payload ID: 9762
  Gene Symbol: HLA-C
  Gene Name: major histocompatibility complex, class I, C
  ENST ID: ENST00000464914
  CDS Start-End: 3-677
agatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcaggtcaggaccagaagtcgctgttcctccctcagagactagaactttccaatgaataggagattatcccagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctggg

SEQ ID NO: 150790 - DNA, 1538 bp, Homo sapiens
  Payload ID: 9762
  Gene Symbol: HLA-C
  Gene Name: major histocompatibility complex, class I, C
  ENST ID: ENST00000476248
  CDS Start-End: 35-430
cccacccggactcacattctccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcgtctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 150791 - DNA, 966 bp, Homo sapiens
  Payload ID: 9762
  Gene Symbol: HLA-C
  Gene Name: major histocompatibility complex, class I, C
  ENST ID: ENST00000461937
  CDS Start-End: 3-677
agatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcgggtcaggaccagaagtcgctgttcctccctcagagactagaactttccaatgaataggagattatcccagaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatggg

SEQ ID NO: 150792 - DNA, 1536 bp, Homo sapiens; identical to SEQ ID NO: 150785
  Payload ID: 9762
  Gene Symbol: HLA-C
  Gene Name: major histocompatibility complex, class I, C
  ENST ID: ENST00000469544
  CDS Start-End: 35-430

SEQ ID NO: 150793 - DNA, 147 bp, Homo sapiens
  Payload ID: 9762
  Gene Symbol: HLA-C
  Gene Name: major histocompatibility complex, class I, C
  ENST ID: ENST00000621261
  CDS Start-End: 1-147
gctgtggtggtgccttctggacaagagcagagatacacgtgccatatgcagcacgaggggctgcaagagcccctcaccctgagctggggtggaaaaggagggagctgctctcaggctgcgtgcagcaacagtgcccagggctctgat

SEQ ID NO: 150794 - DNA, 147 bp, Homo sapiens
  Payload ID: 9762
  Gene Symbol: HLA-C
  Gene Name: major histocompatibility complex, class I, C
  ENST ID: ENST00000618255
  CDS Start-End: 1-147
gctgtggtggtgccttctggagaagagcagagatacacgtgccatgtgcagcacgaggggctgccagagcccctcaccctgagatggggtggaaaaggagggagctgctctcaggctgcgtccagcaacagtgcccagggctctgat

SEQ ID NO: 150795 - DNA, 147 bp, Homo sapiens
  Payload ID: 9762
  Gene Symbol: HLA-C
  Gene Name: major histocompatibility complex, class I, C
  ENST ID: ENST00000619148
  CDS Start-End: 1-147
gctgtggtggtgccttctggagaagagcagagatacacgtgccatgtgcagcacgaggggctgccggagcccctcaccctgagatggggtggaaaaggagggagctgctctcaggctgcgtccagcaacagtgcccagggctctgat

SEQ ID NO: 150796 - DNA, 2601 bp, Homo sapiens
  Payload ID: 9763
  Gene Symbol: HLA-E
  Gene Name: major histocompatibility complex, class I, E
  ENST ID: ENST00000376630
  CDS Start-End: 66-1142
acgactcccgactataaagtccccatccggactcaagaagttctcaggactcagaggctgggatcatggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctactacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattgaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttca

SEQ ID NO: 150797 - DNA, 2601 bp, Homo sapiens
  Payload ID: 9763
  Gene Symbol: HLA-E
  Gene Name: major histocompatibility complex, class I, E
  Uniprot ID: P13747
  ENST ID: ENST00000383597
  CDS Start-End: 66-1142
acgactcccgactataaagtccccatccggactcaagaagttctcaggactcagaggctgggatcatggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaacctgcggacgctgcgcggctactacaatcagagcgaggccgggtctcacaccctgcagtggatgcatggctgcgagctggggcccgacaggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttca

SEQ ID NO: 150798 - DNA, 2601 bp, Homo sapiens; identical to SEQ ID NO: 150797
  Payload ID: 9763
  Gene Symbol: HLA-E
  Gene Name: major histocompatibility complex, class I, E
  Uniprot ID: P13747
  ENST ID: ENST00000415649
  CDS Start-End: 66-1142

SEQ ID NO: 150799 - DNA, 2601 bp, Homo sapiens; identical to SEQ ID NO: 150797
  Payload ID: 9763
  Gene Symbol: HLA-E
  Gene Name: major histocompatibility complex, class I, E
  Uniprot ID: P13747
  ENST ID: ENST00000427936
  CDS Start-End: 66-1142

SEQ ID NO: 150800 - DNA, 2601 bp, Homo sapiens; identical to SEQ ID NO: 150796
  Payload ID: 9763
  Gene Symbol: HLA-E
  Gene Name: major histocompatibility complex, class I, E
  ENST ID: ENST00000444683
  CDS Start-End: 66-1142

SEQ ID NO: 150801 - DNA, 2601 bp, Homo sapiens; identical to SEQ ID NO: 150796
  Payload ID: 9763
  Gene Symbol: HLA-E
  Gene Name: major histocompatibility complex, class I, E
  ENST ID: ENST00000425603
  CDS Start-End: 66-1142

SEQ ID NO: 150802 - DNA, 2601 bp, Homo sapiens; identical to SEQ ID NO: 150797
  Payload ID: 9763
  Gene Symbol: HLA-E
  Gene Name: major histocompatibility complex, class I, E
  Uniprot ID: P13747
  ENST ID: ENST00000415289
  CDS Start-End: 66-1142

SEQ ID NO: 150803 - DNA, 1635 bp, Homo sapiens
  Payload ID: 9764
  Gene Symbol: HLA-F
  Gene Name: major histocompatibility complex, class I, F
  Uniprot ID: P30511
  ENST ID: ENST00000259951
  CDS Start-End: 186-1514
ttctctttctctcccaacccgtgtcaggtccttcttcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggaaacttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatatta

SEQ ID NO: 150804 - DNA, 1283 bp, Homo sapiens
  Payload ID: 9764
  Gene Symbol: HLA-F
  Gene Name: major histocompatibility complex, class I, F
  Uniprot ID: P30511
  ENST ID: ENST00000334668
  CDS Start-End: 125-1165
tttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagat

SEQ ID NO: 150805 - DNA, 1544 bp, Homo sapiens
  Payload ID: 9764
  Gene Symbol: HLA-F
  Gene Name: major histocompatibility complex, class I, F
  ENST ID: ENST00000342322
  CDS Start-End: 385-1425
gaaggagaggaagaggaagaggaagaagaagaagaagaagaagaagaagaagaagaagaagaagaagaagaagaagaagaagaagaagaagaagaagaagaagaagaagaagaagaaaaggaagaagaagaaactgtctctacaccttcattctcaggacaagttcattgtctggcaccaagctccttggggtgaattttcttccaaaagagtccggggagtccaggtccttcttcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 150806 - DNA, 884 bp, Homo sapiens
  Payload ID: 9764
  Gene Symbol: HLA-F
  Gene Name: major histocompatibility complex, class I, F
  Uniprot ID: P30511
  ENST ID: ENST00000359076
  CDS Start-End: 1-765
atggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 150807 - DNA, 1059 bp, Homo sapiens
  Payload ID: 9764
  Gene Symbol: HLA-F
  Gene Name: major histocompatibility complex, class I, F
  ENST ID: ENST00000376844
  CDS Start-End: 57-1059
aaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcag

SEQ ID NO: 150808 - DNA, 884 bp, Homo sapiens
  Payload ID: 9764
  Gene Symbol: HLA-F
  Gene Name: major histocompatibility complex, class I, F
  Uniprot ID: P30511
  ENST ID: ENST00000376848
  CDS Start-End: 1-765
atggcgccccgaagcctcctcctgctgctctcaggggccctggccctgaccgatacttgggcaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 150809 - DNA, 1544 bp, Homo sapiens
  Payload ID: 9764
  Gene Symbol: HLA-F
  Gene Name: major histocompatibility complex, class I, F
  Uniprot ID: P30511
  ENST ID: ENST00000376861
  CDS Start-End: 385-1425
gaagaggaagaggaagaagaagaagaagaagaagaagaagaagaagaagaagaagaagaagaagaagaagaagaagaagaagaagaagaagaagaagaagaagaagaagaagaagaaaaggaagaagaagaaactgtctctacaccttcattctcaggacaagttcattgtctggcaccaagctccttggggtgaattttcttccaaaagagtccggggagtccaggtccttcttcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 150810 - DNA, 884 bp, Homo sapiens; identical to SEQ ID NO: 150806
  Payload ID: 9764
  Gene Symbol: HLA-F
  Gene Name: major histocompatibility complex, class I, F
  Uniprot ID: P30511
  ENST ID: ENST00000383515
  CDS Start-End: 1-765

SEQ ID NO: 150811 - DNA, 1506 bp, Homo sapiens
  Payload ID: 9764
  Gene Symbol: HLA-F
  Gene Name: major histocompatibility complex, class I, F
  ENST ID: ENST00000383516
  CDS Start-End: 57-1385
aaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggaaacttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatatta

SEQ ID NO: 150812 - DNA, 1544 bp, Homo sapiens
  Payload ID: 9764
  Gene Symbol: HLA-F
  Gene Name: major histocompatibility complex, class I, F
  ENST ID: ENST00000383626
  CDS Start-End: 385-1425
gaagaggaagaggaagaggaagaggaagaagaagaagaagaagaagaagaagaagaagaagaagaagaagaagaagaagaagaagaagaagaagaagaagaagaagaagaagaagaagaggaagaagaagaaactgtctctagaccttcattctcaggacaagttcattgtctggcaccaagctccttggggtgaattttcttccaaaagagtccggggagtccaggtccttcatcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 150813 - DNA, 1506 bp, Homo sapiens; identical to SEQ ID NO: 150811
  Payload ID: 9764
  Gene Symbol: HLA-F
  Gene Name: major histocompatibility complex, class I, F
  ENST ID: ENST00000383627
  CDS Start-End: 57-1385

SEQ ID NO: 150814 - DNA, 1506 bp, Homo sapiens; identical to SEQ ID NO: 150811
  Payload ID: 9764
  Gene Symbol: HLA-F
  Gene Name: major histocompatibility complex, class I, F
  ENST ID: ENST00000428296
  CDS Start-End: 57-1385

SEQ ID NO: 150815 - DNA, 578 bp, Homo sapiens
  Payload ID: 9764
  Gene Symbol: HLA-F
  Gene Name: major histocompatibility complex, class I, F
  ENST ID: ENST00000447400
  CDS Start-End: 186-578
ttctctttctctcccaacccgtgtcaggtccttcatcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctc

SEQ ID NO: 150816 - DNA, 578 bp, Homo sapiens
  Payload ID: 9764
  Gene Symbol: HLA-F
  Gene Name: major histocompatibility complex, class I, F
  ENST ID: ENST00000444057
  CDS Start-End: 186-578
ttctctttctctcccaacccgtgtcaggtccttcttcctggttactcataacgcggccccatttctcactcccattgggcgtcgggtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctc

SEQ ID NO: 150817 - DNA, 796 bp, Homo sapiens
  Payload ID: 9764
  Gene Symbol: HLA-F
  Gene Name: major histocompatibility complex, class I, F
  ENST ID: ENST00000454779
  CDS Start-End: 1-677
gcccagaccctccacccgggagagtcccaggcgcctttacccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 150818 - DNA, 495 bp, Homo sapiens
  Payload ID: 9764
  Gene Symbol: HLA-F
  Gene Name: major histocompatibility complex, class I, F
  ENST ID: ENST00000444621
  CDS Start-End: 1-374
ctgctgtgatgtggaggaagaagagctcaggacattttcttcccatagatagaaacagagggagctactctcaggctgcagcctactcagtggtcagcggaaacttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatatta

SEQ ID NO: 150819 - DNA, 884 bp, Homo sapiens; identical to SEQ ID NO: 150806
  Payload ID: 9764
  Gene Symbol: HLA-F
  Gene Name: major histocompatibility complex, class I, F
  Uniprot ID: P30511
  ENST ID: ENST00000420067
  CDS Start-End: 1-765

SEQ ID NO: 150820 - DNA, 1544 bp, Homo sapiens
  Payload ID: 9764
  Gene Symbol: HLA-F
  Gene Name: major histocompatibility complex, class I, F
  ENST ID: ENST00000422711
  CDS Start-End: 385-1425
gaagaagaagaagaagaggaagaggaagaggaagaagaagaagaagaagaagaagaagaagaagaagaagaagaagaagaagaagaagaagaagaagaagaagaagaagaagaagaagaggaagaagaagaaactgtctctagaccttcattctcaggacaagttcattgtctggcaccaagctccttggggtgaattttcttccaaaagagtccggggagtccaggtccttcatcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 150821 - DNA, 578 bp, Homo sapiens; identical to SEQ ID NO: 150815
  Payload ID: 9764
  Gene Symbol: HLA-F
  Gene Name: major histocompatibility complex, class I, F
  ENST ID: ENST00000437020
  CDS Start-End: 186-578

SEQ ID NO: 150822 - DNA, 884 bp, Homo sapiens; identical to SEQ ID NO: 150806
  Payload ID: 9764
  Gene Symbol: HLA-F
  Gene Name: major histocompatibility complex, class I, F
  Uniprot ID: P30511
  ENST ID: ENST00000434407
  CDS Start-End: 1-765

SEQ ID NO: 150823 - DNA, 1506 bp, Homo sapiens
  Payload ID: 9764
  Gene Symbol: HLA-F
  Gene Name: major histocompatibility complex, class I, F
  ENST ID: ENST00000430472
  CDS Start-End: 57-1385
aaagtcccacgcaccccgcgggactcatatttttcccagacgcggaggttggggtcatggcgccccgaagcctcctcctgctgctctcaggggccctggccctgaccgatacttgggcaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggactcttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatatta

SEQ ID NO: 150824 - DNA, 796 bp, Homo sapiens
  Payload ID: 9764
  Gene Symbol: HLA-F
  Gene Name: major histocompatibility complex, class I, F
  ENST ID: ENST00000433515
  CDS Start-End: 1-677
gcccagaccctccacccgggagagtcccaggcgcctttaccgagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 150825 - DNA, 495 bp, Homo sapiens; identical to SEQ ID NO: 150818
  Payload ID: 9764
  Gene Symbol: HLA-F
  Gene Name: major histocompatibility complex, class I, F
  ENST ID: ENST00000458026
  CDS Start-End: 1-374

SEQ ID NO: 150826 - DNA, 495 bp, Homo sapiens
  Payload ID: 9764
  Gene Symbol: HLA-F
  Gene Name: major histocompatibility complex, class I, F
  ENST ID: ENST00000448064
  CDS Start-End: 1-374
ctgctgtgatgtggaggaagaagagctcaggacattttcttcccatagatagaaacagagggagctactctcaggctgcagcctactcagtggtcagcggactcttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatatta

SEQ ID NO: 150827 - DNA, 884 bp, Homo sapiens; identical to SEQ ID NO: 150806
  Payload ID: 9764
  Gene Symbol: HLA-F
  Gene Name: major histocompatibility complex, class I, F
  Uniprot ID: P30511
  ENST ID: ENST00000440590
  CDS Start-End: 1-765

SEQ ID NO: 150828 - DNA, 796 bp, Homo sapiens; identical to SEQ ID NO: 150824
  Payload ID: 9764
  Gene Symbol: HLA-F
  Gene Name: major histocompatibility complex, class I, F
  ENST ID: ENST00000420923
  CDS Start-End: 1-677

SEQ ID NO: 150829 - DNA, 30 bp, Homo sapiens
  Payload ID: 9764
  Gene Symbol: HLA-F
  Gene Name: major histocompatibility complex, class I, F
  ENST ID: ENST00000437226
  CDS Start-End: 1-30
ctgctgtgatgtggaggaagaagagctcag

SEQ ID NO: 150830 - DNA, 1504 bp, Homo sapiens
  Payload ID: 9764
  Gene Symbol: HLA-F
  Gene Name: major histocompatibility complex, class I, F
  ENST ID: ENST00000444891
  CDS Start-End: 345-1385
agaagaagaggaggggggcggggaggagcaggaggaggaggaaagaaggaggagaaggagaaggagaaggagaagaagaagaagaagaagaaactgtctctacaccttcattctcaggacaagttcattgtctggcaccaagctccttggggtgaattttcttccaaaagagtccggggagtccaggtccttcttcctggttactcataacgcggccccatttctcactcccattgggcgtcgggtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 150831 - DNA, 495 bp, Homo sapiens; identical to SEQ ID NO: 150818
  Payload ID: 9764
  Gene Symbol: HLA-F
  Gene Name: major histocompatibility complex, class I, F
  ENST ID: ENST00000426470
  CDS Start-End: 1-374

SEQ ID NO: 150832 - DNA, 578 bp, Homo sapiens; identical to SEQ ID NO: 150815
  Payload ID: 9764
  Gene Symbol: HLA-F
  Gene Name: major histocompatibility complex, class I, F
  ENST ID: ENST00000418017
  CDS Start-End: 186-578

SEQ ID NO: 150833 - DNA, 727 bp, Homo sapiens
  Payload ID: 9764
  Gene Symbol: HLA-F
  Gene Name: major histocompatibility complex, class I, F
  ENST ID: ENST00000441200
  CDS Start-End: 1-727
atggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagagcagtctccccagcccaccatccccatcgtgggcatcgttgctggccttgttgtccttggagctgtggtcactggagctgtggtcgctgctgtgatgtggaggaagaagagctcag

SEQ ID NO: 150834 - DNA, 578 bp, Homo sapiens
  Payload ID: 9764
  Gene Symbol: HLA-F
  Gene Name: major histocompatibility complex, class I, F
  ENST ID: ENST00000420414
  CDS Start-End: 186-578
ttctctttctctcccaacccgtgtcaggtccttcttcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctc

SEQ ID NO: 150835 - DNA, 1544 bp, Homo sapiens; identical to SEQ ID NO: 150812
  Payload ID: 9764
  Gene Symbol: HLA-F
  Gene Name: major histocompatibility complex, class I, F
  ENST ID: ENST00000435058
  CDS Start-End: 385-1425

SEQ ID NO: 150836 - DNA, 578 bp, Homo sapiens; identical to SEQ ID NO: 150815
  Payload ID: 9764
  Gene Symbol: HLA-F
  Gene Name: major histocompatibility complex, class I, F
  ENST ID: ENST00000414958
  CDS Start-End: 186-578

SEQ ID NO: 150837 - DNA, 495 bp, Homo sapiens; identical to SEQ ID NO: 150818
  Payload ID: 9764
  Gene Symbol: HLA-F
  Gene Name: major histocompatibility complex, class I, F
  ENST ID: ENST00000425139
  CDS Start-End: 1-374

SEQ ID NO: 150838 - DNA, 1408 bp, Homo sapiens
  Payload ID: 9764
  Gene Symbol: HLA-F
  Gene Name: major histocompatibility complex, class I, F
  ENST ID: ENST00000422439
  CDS Start-End: 406-1408
gaagaagaagaagaagaagaagaagaagaagaggaagaggaagaggaagaggaagaagaagaagaagaagaagaagaagaagaagaagaagaagaagaagaagaagaagaagaagaagaagaagaagaagaggaagaagaggaagaagaagaaactgtctctagaccttcattctcaggacaagttcattgtctggcaccaagctccttggggtgaattttcttccaaaagagtccggggagtccaggtccttcatcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcag

SEQ ID NO: 150839 - DNA, 796 bp, Homo sapiens; identical to SEQ ID NO: 150817
  Payload ID: 9764
  Gene Symbol: HLA-F
  Gene Name: major histocompatibility complex, class I, F
  ENST ID: ENST00000454646
  CDS Start-End: 1-677

SEQ ID NO: 150840 - DNA, 1506 bp, Homo sapiens; identical to SEQ ID NO: 150811
  Payload ID: 9764
  Gene Symbol: HLA-F
  Gene Name: major histocompatibility complex, class I, F
  ENST ID: ENST00000445657
  CDS Start-End: 57-1385

SEQ ID NO: 150841 - DNA, 495 bp, Homo sapiens; identical to SEQ ID NO: 150818
  Payload ID: 9764
  Gene Symbol: HLA-F
  Gene Name: major histocompatibility complex, class I, F
  ENST ID: ENST00000452916
  CDS Start-End: 1-374

SEQ ID NO: 150842 - DNA, 796 bp, Homo sapiens; identical to SEQ ID NO: 150824
  Payload ID: 9764
  Gene Symbol: HLA-F
  Gene Name: major histocompatibility complex, class I, F
  ENST ID: ENST00000426675
  CDS Start-End: 1-677

SEQ ID NO: 150843 - DNA, 639 bp, Homo sapiens
  Payload ID: 9764
  Gene Symbol: HLA-F
  Gene Name: major histocompatibility complex, class I, F
  ENST ID: ENST00000420024
  CDS Start-End: 1-639
gcccagaccctccacccgggagagtcccaggcgcctttaccgagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcag

SEQ ID NO: 150844 - DNA, 1283 bp, Homo sapiens
  Payload ID: 9764
  Gene Symbol: HLA-F
  Gene Name: major histocompatibility complex, class I, F
  ENST ID: ENST00000552082
  CDS Start-End: 125-1165
tttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagat

SEQ ID NO: 150845 - DNA, 1283 bp, Homo sapiens; identical to SEQ ID NO: 150844
  Payload ID: 9764
  Gene Symbol: HLA-F
  Gene Name: major histocompatibility complex, class I, F
  ENST ID: ENST00000551780
  CDS Start-End: 125-1165

SEQ ID NO: 150846 - DNA, 1283 bp, Homo sapiens; identical to SEQ ID NO: 150844
  Payload ID: 9764
  Gene Symbol: HLA-F
  Gene Name: major histocompatibility complex, class I, F
  ENST ID: ENST00000551832
  CDS Start-End: 125-1165

SEQ ID NO: 150847 - DNA, 1283 bp, Homo sapiens
  Payload ID: 9764
  Gene Symbol: HLA-F
  Gene Name: major histocompatibility complex, class I, F
  ENST ID: ENST00000549422
  CDS Start-End: 125-1165
tttctcactcccattgggcgtcgggtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagat

SEQ ID NO: 150848 - DNA, 1283 bp, Homo sapiens; identical to SEQ ID NO: 150844
  Payload ID: 9764
  Gene Symbol: HLA-F
  Gene Name: major histocompatibility complex, class I, F
  ENST ID: ENST00000550932
  CDS Start-End: 125-1165

SEQ ID NO: 150849 - DNA, 1017 bp, Homo sapiens
  Payload ID: 9764
  Gene Symbol: HLA-F
  Gene Name: major histocompatibility complex, class I, F
  ENST ID: ENST00000617604
  CDS Start-End: 1-1017
ggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagttgctgtaatcactgtagctgtggtcgctgctgtgatgtggaggaataagatcccaggtaggaaaggggtgagctctgagtttccttcttccaggaacagtacccagggctctgatgtgtctctcaaggct

SEQ ID NO: 150850 - DNA, 762 bp, Homo sapiens
  Payload ID: 9764
  Gene Symbol: HLA-F
  Gene Name: major histocompatibility complex, class I, F
  ENST ID: ENST00000613731
  CDS Start-End: 1-762
atggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagagcagtctccccagcccaccatccccatcgtgggcatcgttgctggccttgttgtccttggagctgtggtcactggagctgtggtcgctgctgtgatgtggaggaagaagagctcaggtaggaagggcagtcacaaatcacaggggaaggtc

SEQ ID NO: 150851 - DNA, 1038 bp, Homo sapiens
  Payload ID: 9764
  Gene Symbol: HLA-F
  Gene Name: major histocompatibility complex, class I, F
  ENST ID: ENST00000622145
  CDS Start-End: 1-1038
atggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcaggtaggaagggcagtcacaaatcacaggggaaggtc

SEQ ID NO: 150852 - DNA, 1505 bp, Homo sapiens
  Payload ID: 9764
  Gene Symbol: HLA-F
  Gene Name: major histocompatibility complex, class I, F
  ENST ID: ENST00000475996
  CDS Start-End: 1-217
tccccagcccaccatccccatcgtgggcatcgttgctggccttgttgtccttggagctgtggtcactggagctgtggtcgctgctgtgatgtggaggaagaagagctcaggcccagctcctgagtgtctctacctctcaaacaagtattctcatccaggagcaattttcccaccagaggacattagctatgtctggaaaaatgttttgttgccatgactggagtgaggaggaggtgctaccagcatcttgtggggaatgaccagggatgctgaacatcctgcagtgcacaagtcagcccaatcacccacataacagataattatccagccccaataccaagattgccaagggtaaggaggcctgccaggactttctctcccttgagtacaagcttccttgaactgagggacaccctgaaggaaaagtgtggtcccaccccagtcatctctcccttccctggagctccatctgtatgcctgtagtgcttaggcctgtaacctggggtccaggaacccaccttcccatgagactgcatgcagaagtgatgatatgtgcacacatgacttcattacagggcattggatgttgatattcatcaggtcagctggggcccaagacactactcttctgccaacaggccgcaatcctctgcattagagagagggtaaagattgagggaggccctaacttcaaaccttctatcactgctagtgaagtgccaaaaagaagtgcaaggtcatctgcccttgtaggaaccacacaggaaggcagagtgtccaccaatgtcaaattccatcaaagaaataatattttgacaaaaaatgcaagtcacctttctaagtcccagacagcagctcaaaataaaaagcattaaacccctcaaatcttagaccaggtgaaattattgaagctgcagtaaggtcttgtgggacctgcagttagagagaagggacaactcaatttgggactgcagcagaaacccctacatcatggggttcctggaagggaccctctcccttcagcgacgcattgtgaggccatttctaggtaaaaaggtagaatttccttggattcctgaggtttattttacacttactgcttattctttgactttatagaagccaacttcagtttgaacatcttgcaattaattttttttggctctaagtggagaatttgaacttgtttctgaagaaaaccaggggctccttatgtgagcaagcaaccctccctgtggcccccttatgcaataaacataagccattgtgagccagcaaaatttaaagcaaggaaagcagtaaaccctccatttcagcatgtttcagcctgtctagtgatgttctagtcttgcctcactcttaacattttaaaatttataattttatttgattttgatttaataagaattcatatgtattcatttcttttgggtttgtcaccaaaagcctcctccaatcacctgtggagtaaagacaagtaaataaatgcatggtgttcccattta

SEQ ID NO: 150853 - DNA, 623 bp, Homo sapiens
  Payload ID: 9764
  Gene Symbol: HLA-F
  Gene Name: major histocompatibility complex, class I, F
  ENST ID: ENST00000465459
  CDS Start-End: 1-432
caccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcaggaaagttgactcatactggtgtccagtgaagaaacccaggcgcataagagggacagttggatctcagggaggactgtcttcttctcacctccccggacgatgcttcttgacacaggaaagaggatgtgctgctagggtcatcatgtcctggtttattgtgttgtcagtagaatgaaatcaaaatacatacttcataaataataaaataacccataataag

SEQ ID NO: 150854 - DNA, 1427 bp, Homo sapiens
  Payload ID: 9765
  Gene Symbol: HLA-G
  Gene Name: major histocompatibility complex, class I, G
  Uniprot ID: P17693
  ENST ID: ENST00000360323
  CDS Start-End: 25-1041
actcattctccccagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgactcctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgatgggttaattaaaggagaagattcctgaaatttgagagacaaaataaatggaagacatgagaactttcca

SEQ ID NO: 150855 - DNA, 851 bp, Homo sapiens
  Payload ID: 9765
  Gene Symbol: HLA-G
  Gene Name: major histocompatibility complex, class I, G
  ENST ID: ENST00000376815
  CDS Start-End: 1-465
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgactcctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgatgggttaattaaaggagaagattcctgaaatttgagagacaaaataaatggaagacatgagaactttcca

SEQ ID NO: 150856 - DNA, 1127 bp, Homo sapiens
  Payload ID: 9765
  Gene Symbol: HLA-G
  Gene Name: major histocompatibility complex, class I, G
  ENST ID: ENST00000376818
  CDS Start-End: 1-741
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgactcctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgatgggttaattaaaggagaagattcctgaaatttgagagacaaaataaatggaagacatgagaactttcca

SEQ ID NO: 150857 - DNA, 1490 bp, Homo sapiens
  Payload ID: 9765
  Gene Symbol: HLA-G
  Gene Name: major histocompatibility complex, class I, G
  ENST ID: ENST00000376828
  CDS Start-End: 73-1104
atatagtaacatagtgtggtactttgtcttgaggagatgtcctggactcacacggaaacttagggctacggaatgaagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgactcctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgatgggttaattaaaggagaagattcctgaaatttgagagacaaaataaatggaagacatgagaactttcca

SEQ ID NO: 150858 - DNA, 1443 bp, Homo sapiens
  Payload ID: 9765
  Gene Symbol: HLA-G
  Gene Name: major histocompatibility complex, class I, G
  Uniprot ID: P17693
  ENST ID: ENST00000383621
  CDS Start-End: 25-1041
actcattctccccagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttccaca

SEQ ID NO: 150859 - DNA, 867 bp, Homo sapiens
  Payload ID: 9765
  Gene Symbol: HLA-G
  Gene Name: major histocompatibility complex, class I, G
  ENST ID: ENST00000383622
  CDS Start-End: 1-465
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttccaca

SEQ ID NO: 150860 - DNA, 1143 bp, Homo sapiens
  Payload ID: 9765
  Gene Symbol: HLA-G
  Gene Name: major histocompatibility complex, class I, G
  ENST ID: ENST00000383623
  CDS Start-End: 1-741
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttccaca

SEQ ID NO: 150861 - DNA, 1497 bp, Homo sapiens
  Payload ID: 9765
  Gene Symbol: HLA-G
  Gene Name: major histocompatibility complex, class I, G
  ENST ID: ENST00000400665
  CDS Start-End: 73-1104
atatagtaacatagtgtggtactttgtcttgaggagatgtcctggactcacacggaaacttagggctacggaatgaagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaa

SEQ ID NO: 150862 - DNA, 1506 bp, Homo sapiens
  Payload ID: 9765
  Gene Symbol: HLA-G
  Gene Name: major histocompatibility complex, class I, G
  ENST ID: ENST00000400682
  CDS Start-End: 73-1104
atatagtaacatagtgtggtactttgtcttgaggagatgtcctggactcacacggaaacttagggctacggaatgaagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttccaca

SEQ ID NO: 150863 - DNA, 1490 bp, Homo sapiens
  Payload ID: 9765
  Gene Symbol: HLA-G
  Gene Name: major histocompatibility complex, class I, G
  ENST ID: ENST00000422371
  CDS Start-End: 73-1104
atatagtaacatagtgtggtactttgtcttgaggagatgtcctggactcacacggaaacttagggctacggaatgaagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgataggttaattaaaggagaagattcctgaaatttgagagacaaaataaatggaagacatgagaactttcca

SEQ ID NO: 150864 - DNA, 1427 bp, Homo sapiens
  Payload ID: 9765
  Gene Symbol: HLA-G
  Gene Name: major histocompatibility complex, class I, G
  Uniprot ID: P17693
  ENST ID: ENST00000428952
  CDS Start-End: 25-1041
actcattctccccagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgataggttaattaaaggagaagattcctgaaatttgagagacaaaataaatggaagacatgagaactttcca

SEQ ID NO: 150865 - DNA, 1441 bp, Homo sapiens
  Payload ID: 9765
  Gene Symbol: HLA-G
  Gene Name: major histocompatibility complex, class I, G
  Uniprot ID: P17693
  ENST ID: ENST00000423011
  CDS Start-End: 25-1041
actcattctccccagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcttgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 150866 - DNA, 851 bp, Homo sapiens
  Payload ID: 9765
  Gene Symbol: HLA-G
  Gene Name: major histocompatibility complex, class I, G
  ENST ID: ENST00000415687
  CDS Start-End: 1-465
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcca

SEQ ID NO: 150867 - DNA, 1134 bp, Homo sapiens
  Payload ID: 9765
  Gene Symbol: HLA-G
  Gene Name: major histocompatibility complex, class I, G
  ENST ID: ENST00000452715
  CDS Start-End: 1-741
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaa

SEQ ID NO: 150868 - DNA, 1127 bp, Homo sapiens
  Payload ID: 9765
  Gene Symbol: HLA-G
  Gene Name: major histocompatibility complex, class I, G
  ENST ID: ENST00000426863
  CDS Start-End: 1-741
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgataggttaattaaaggagaagattcctgaaatttgagagacaaaataaatggaagacatgagaactttcca

SEQ ID NO: 150869 - DNA, 1504 bp, Homo sapiens
  Payload ID: 9765
  Gene Symbol: HLA-G
  Gene Name: major histocompatibility complex, class I, G
  ENST ID: ENST00000434881
  CDS Start-End: 73-1104
atatagtaacatagtgtggtactttgtcttgaggagatgtcctggactcacacggaaacttagggctacggaatgaagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcttgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 150870 - DNA, 1189 bp, Homo sapiens
  Payload ID: 9765
  Gene Symbol: HLA-G
  Gene Name: major histocompatibility complex, class I, G
  ENST ID: ENST00000430253
  CDS Start-End: 1-741
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcttgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaagcagtgacagtgcccagggctctaatgtgtctctcacggcttgtaaattgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 150871 - DNA, 1490 bp, Homo sapiens
  Payload ID: 9765
  Gene Symbol: HLA-G
  Gene Name: major histocompatibility complex, class I, G
  ENST ID: ENST00000420559
  CDS Start-End: 73-1104
atatagtaacatagtgtggtactttgtcttgaggagatgtcctggactcacacggaaacttagggctacggaatgaagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcca

SEQ ID NO: 150872 - DNA, 1127 bp, Homo sapiens
  Payload ID: 9765
  Gene Symbol: HLA-G
  Gene Name: major histocompatibility complex, class I, G
  ENST ID: ENST00000412263
  CDS Start-End: 1-741
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcca

SEQ ID NO: 150873 - DNA, 1434 bp, Homo sapiens
  Payload ID: 9765
  Gene Symbol: HLA-G
  Gene Name: major histocompatibility complex, class I, G
  Uniprot ID: P17693
  ENST ID: ENST00000444098
  CDS Start-End: 25-1041
actcattctccccagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaa

SEQ ID NO: 150874 - DNA, 851 bp, Homo sapiens
  Payload ID: 9765
  Gene Symbol: HLA-G
  Gene Name: major histocompatibility complex, class I, G
  ENST ID: ENST00000429890
  CDS Start-End: 1-465
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgataggttaattaaaggagaagattcctgaaatttgagagacaaaataaatggaagacatgagaactttcca

SEQ ID NO: 150875 - DNA, 1427 bp, Homo sapiens
  Payload ID: 9765
  Gene Symbol: HLA-G
  Gene Name: major histocompatibility complex, class I, G
  Uniprot ID: P17693
  ENST ID: ENST00000423373
  CDS Start-End: 25-1041
actcattctccccagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcca

SEQ ID NO: 150876 - DNA, 1141 bp, Homo sapiens
  Payload ID: 9765
  Gene Symbol: HLA-G
  Gene Name: major histocompatibility complex, class I, G
  ENST ID: ENST00000434907
  CDS Start-End: 1-741
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcttgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 150877 - DNA, 1427 bp, Homo sapiens; identical to SEQ ID NO: 150875
  Payload ID: 9765
  Gene Symbol: HLA-G
  Gene Name: major histocompatibility complex, class I, G
  Uniprot ID: P17693
  ENST ID: ENST00000449127
  CDS Start-End: 25-1041

SEQ ID NO: 150878 - DNA, 1490 bp, Homo sapiens; identical to SEQ ID NO: 150871
  Payload ID: 9765
  Gene Symbol: HLA-G
  Gene Name: major histocompatibility complex, class I, G
  ENST ID: ENST00000450984
  CDS Start-End: 73-1104

SEQ ID NO: 150879 - DNA, 851 bp, Homo sapiens; identical to SEQ ID NO: 150866
  Payload ID: 9765
  Gene Symbol: HLA-G
  Gene Name: major histocompatibility complex, class I, G
  ENST ID: ENST00000457132
  CDS Start-End: 1-465

SEQ ID NO: 150880 - DNA, 1578 bp, Homo sapiens
  Payload ID: 9765
  Gene Symbol: HLA-G
  Gene Name: major histocompatibility complex, class I, G
  Uniprot ID: P17693
  ENST ID: ENST00000428701
  CDS Start-End: 179-1195
agtgtggtactttgtcttgaggagatgtcctggactcacacggaaacttagggctacggaatgaagttctcactcccattaggtgacaggtttttagagaagccaatcagcgtcgccgcggtcctggttctaaagtcctcgctcacccacccggactcattctccccagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgactcctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgatgggttaattaaaggagaagattcctgaaatttgagagacaaaataaatggaagacatgagaacttt

SEQ ID NO: 150881 - DNA, 865 bp, Homo sapiens
  Payload ID: 9765
  Gene Symbol: HLA-G
  Gene Name: major histocompatibility complex, class I, G
  ENST ID: ENST00000448306
  CDS Start-End: 1-465
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcttgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 150882 - DNA, 1127 bp, Homo sapiens; identical to SEQ ID NO: 150872
  Payload ID: 9765
  Gene Symbol: HLA-G
  Gene Name: major histocompatibility complex, class I, G
  ENST ID: ENST00000452577
  CDS Start-End: 1-741

SEQ ID NO: 150883 - DNA, 858 bp, Homo sapiens
  Payload ID: 9765
  Gene Symbol: HLA-G
  Gene Name: major histocompatibility complex, class I, G
  ENST ID: ENST00000445373
  CDS Start-End: 1-465
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaa

SEQ ID NO: 150884 - DNA, 1191 bp, Homo sapiens
  Payload ID: 9765
  Gene Symbol: HLA-G
  Gene Name: major histocompatibility complex, class I, G
  ENST ID: ENST00000469472
  CDS Start-End: 1-741
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaagcagtgacagtgcccagggctctaatgtgtctctcacggcttgtaaattgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttccaca

SEQ ID NO: 150885 - DNA, 1182 bp, Homo sapiens
  Payload ID: 9765
  Gene Symbol: HLA-G
  Gene Name: major histocompatibility complex, class I, G
  ENST ID: ENST00000486553
  CDS Start-End: 1-741
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaagcagtgacagtgcccagggctctaatgtgtctctcacggcttgtaaattgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaa

SEQ ID NO: 150886 - DNA, 1175 bp, Homo sapiens
  Payload ID: 9765
  Gene Symbol: HLA-G
  Gene Name: major histocompatibility complex, class I, G
  ENST ID: ENST00000466488
  CDS Start-End: 1-741
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaagcagtgacagtgcccagggctctaatgtgtctctcacggcttgtaaattgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcca

SEQ ID NO: 150887 - DNA, 1175 bp, Homo sapiens
  Payload ID: 9765
  Gene Symbol: HLA-G
  Gene Name: major histocompatibility complex, class I, G
  ENST ID: ENST00000467814
  CDS Start-End: 1-741
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaagcagtgacagtgcccagggctctaatgtgtctctcacggcttgtaaattgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgataggttaattaaaggagaagattcctgaaatttgagagacaaaataaatggaagacatgagaactttcca

SEQ ID NO: 150888 - DNA, 1175 bp, Homo sapiens
  Payload ID: 9765
  Gene Symbol: HLA-G
  Gene Name: major histocompatibility complex, class I, G
  ENST ID: ENST00000478519
  CDS Start-End: 1-741
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaagcagtgacagtgcccagggctctaatgtgtctctcacggcttgtaaattgtgaaacagctgccctgtgtgggactgagtggcaagtccctttgtgacttcaagaaccctgactcctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgatgggttaattaaaggagaagattcctgaaatttgagagacaaaataaatggaagacatgagaactttcca

SEQ ID NO: 150889 - DNA, 1175 bp, Homo sapiens; identical to SEQ ID NO: 150886
  Payload ID: 9765
  Gene Symbol: HLA-G
  Gene Name: major histocompatibility complex, class I, G
  ENST ID: ENST00000469347
  CDS Start-End: 1-741

SEQ ID NO: 150890 - DNA, 1582 bp, Homo sapiens
  Payload ID: 9765
  Gene Symbol: HLA-G
  Gene Name: major histocompatibility complex, class I, G
  Uniprot ID: P17693
  ENST ID: ENST00000546545
  CDS Start-End: 179-1195
agtgtggtactttgtcttgaggagatgtcctggactcacacggaaacttagggctacggaatgaagttctcactcccattaggtgacaggtttttagagaagccaatcagcgtcgccgcggtcctggttctaaagtcctcgctcacccacccggactcattctccccagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaagtaagtatgaaggaggctgatccctgagatccttgggatcttgtgtttgggagcccatgaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaacttt

SEQ ID NO: 150891 - DNA, 1578 bp, Homo sapiens
  Payload ID: 9765
  Gene Symbol: HLA-G
  Gene Name: major histocompatibility complex, class I, G
  Uniprot ID: P17693
  ENST ID: ENST00000546634
  CDS Start-End: 179-1195
agtgtggtactttgtcttgaggagatgtcctggactcacacggaaacttagggctacggaatgaagttctcactcccattaggtgacaggtttttagagaagccaatcagcgtcgccgcggtcctggttctaaagtcctcgctcacccacccggactcattctccccagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaacttt

SEQ ID NO: 150892 - DNA, 1582 bp, Homo sapiens
  Payload ID: 9765
  Gene Symbol: HLA-G
  Gene Name: major histocompatibility complex, class I, G
  Uniprot ID: P17693
  ENST ID: ENST00000547241
  CDS Start-End: 179-1195
agtgtggtactttgtcttgaggagatgtcctggactcacacggaaacttagggctacggaatgaagttctcactcccattaggtgacaggtttttagagaagccaatcagcgtcgccgcggtcctggttctaaagtcctcgctcacccacccggactcattctccccagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcttgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaagtaagtatgaaggaggctgatccctgagatccttgggatcttgtgtttgggagcccatgaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaacttt

SEQ ID NO: 150893 - DNA, 1578 bp, Homo sapiens; identical to SEQ ID NO: 150891
  Payload ID: 9765
  Gene Symbol: HLA-G
  Gene Name: major histocompatibility complex, class I, G
  Uniprot ID: P17693
  ENST ID: ENST00000547931
  CDS Start-End: 179-1195

SEQ ID NO: 150894 - DNA, 1582 bp, Homo sapiens; identical to SEQ ID NO: 150890
  Payload ID: 9765
  Gene Symbol: HLA-G
  Gene Name: major histocompatibility complex, class I, G
  Uniprot ID: P17693
  ENST ID: ENST00000553052
  CDS Start-End: 179-1195

SEQ ID NO: 150895 - DNA, 1578 bp, Homo sapiens
  Payload ID: 9765
  Gene Symbol: HLA-G
  Gene Name: major histocompatibility complex, class I, G
  Uniprot ID: P17693
  ENST ID: ENST00000550897
  CDS Start-End: 179-1195
agtgtggtactttgtcttgaggagatgtcctggactcacacggaaacttagggctacggaatgaagttctcactcccattaggtgacaggtttttagagaagccaatcagcgtcgccgcggtcctggttctaaagtcctcgctcacccacccggactcattctccccagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgataggttaattaaaggagaagattcctgaaatttgagagacaaaataaatggaagacatgagaacttt

SEQ ID NO: 150896 - DNA, 1141 bp, Homo sapiens
  Payload ID: 9765
  Gene Symbol: HLA-G
  Gene Name: major histocompatibility complex, class I, G
  ENST ID: ENST00000612360
  CDS Start-End: 1-741
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacatgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 150897 - DNA, 1582 bp, Homo sapiens
  Payload ID: 9765
  Gene Symbol: HLA-G
  Gene Name: major histocompatibility complex, class I, G
  ENST ID: ENST00000618812
  CDS Start-End: 179-1195
agtgtggtactttgtcttgaggagatgtcctggactcacacggaaacttagggctacggaatgaagttctcactcccattaggtgacaggtttttagagaagccaatcagcgtcgccgcggtcctggttctaaagtcctcgctcacccacccggactcattctccccagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacatgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaagtaagtatgaaggaggctgatccctgagatccttgggatcttgtgtttgggagcccatgaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaacttt

SEQ ID NO: 150898 - DNA, 865 bp, Homo sapiens
  Payload ID: 9765
  Gene Symbol: HLA-G
  Gene Name: major histocompatibility complex, class I, G
  ENST ID: ENST00000622601
  CDS Start-End: 1-465
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 150899 - DNA, 1441 bp, Homo sapiens
  Payload ID: 9765
  Gene Symbol: HLA-G
  Gene Name: major histocompatibility complex, class I, G
  ENST ID: ENST00000615098
  CDS Start-End: 25-1041
actcattctccccagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacatgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 150900 - DNA, 1189 bp, Homo sapiens
  Payload ID: 9765
  Gene Symbol: HLA-G
  Gene Name: major histocompatibility complex, class I, G
  ENST ID: ENST00000618039
  CDS Start-End: 1-741
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacatgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaagcagtgacagtgcccagggctctaatgtgtctctcacggcttgtaaattgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 150901 - DNA, 1504 bp, Homo sapiens
  Payload ID: 9765
  Gene Symbol: HLA-G
  Gene Name: major histocompatibility complex, class I, G
  ENST ID: ENST00000615464
  CDS Start-End: 73-1104
atatagtaacatagtgtggtactttgtcttgaggagatgtcctggactcacacggaaacttagggctacggaatgaagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacatgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 150902 - DNA, 1123 bp, Homo sapiens
  Payload ID: 9766
  Gene Symbol: HLA-DMA
  Gene Name: major histocompatibility complex, class II, DM alpha
  Uniprot ID: P28067
  ENST ID: ENST00000374843
  CDS Start-End: 87-872
gatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatatca

SEQ ID NO: 150903 - DNA, 1010 bp, Homo sapiens
  Payload ID: 9766
  Gene Symbol: HLA-DMA
  Gene Name: major histocompatibility complex, class II, DM alpha
  ENST ID: ENST00000383227
  CDS Start-End: 73-756
ctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatatca

SEQ ID NO: 150904 - DNA, 780 bp, Homo sapiens
  Payload ID: 9766
  Gene Symbol: HLA-DMA
  Gene Name: major histocompatibility complex, class II, DM alpha
  ENST ID: ENST00000383228
  CDS Start-End: 26-526
cctacctactgtgtggcaagaaggtatgggtcatgaacagaaccaaggagctgcgctgctacagatgttaccacttctgtggctgctaccccactcctgggccgtccctgaagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatatca

SEQ ID NO: 150905 - DNA, 1126 bp, Homo sapiens
  Payload ID: 9766
  Gene Symbol: HLA-DMA
  Gene Name: major histocompatibility complex, class II, DM alpha
  Uniprot ID: P28067
  ENST ID: ENST00000383230
  CDS Start-End: 87-872
gatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatatca

SEQ ID NO: 150906 - DNA, 1007 bp, Homo sapiens
  Payload ID: 9766
  Gene Symbol: HLA-DMA
  Gene Name: major histocompatibility complex, class II, DM alpha
  ENST ID: ENST00000395303
  CDS Start-End: 73-756
ctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatatca

SEQ ID NO: 150907 - DNA, 777 bp, Homo sapiens
  Payload ID: 9766
  Gene Symbol: HLA-DMA
  Gene Name: major histocompatibility complex, class II, DM alpha
  ENST ID: ENST00000395305
  CDS Start-End: 26-526
cctacctactgtgtggcaagaaggtatgggtcatgaacagaaccaaggagctgcgctgctacagatgttaccacttctgtggctgctaccccactcctgggccgtccctgaagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatatca

SEQ ID NO: 150908 - DNA, 1010 bp, Homo sapiens; identical to SEQ ID NO: 150903
  Payload ID: 9766
  Gene Symbol: HLA-DMA
  Gene Name: major histocompatibility complex, class II, DM alpha
  ENST ID: ENST00000432991
  CDS Start-End: 73-756

SEQ ID NO: 150909 - DNA, 780 bp, Homo sapiens; identical to SEQ ID NO: 150904
  Payload ID: 9766
  Gene Symbol: HLA-DMA
  Gene Name: major histocompatibility complex, class II, DM alpha
  ENST ID: ENST00000435503
  CDS Start-End: 26-526

SEQ ID NO: 150910 - DNA, 1126 bp, Homo sapiens; identical to SEQ ID NO: 150905
  Payload ID: 9766
  Gene Symbol: HLA-DMA
  Gene Name: major histocompatibility complex, class II, DM alpha
  Uniprot ID: P28067
  ENST ID: ENST00000450601
  CDS Start-End: 87-872

SEQ ID NO: 150911 - DNA, 1010 bp, Homo sapiens; identical to SEQ ID NO: 150903
  Payload ID: 9766
  Gene Symbol: HLA-DMA
  Gene Name: major histocompatibility complex, class II, DM alpha
  ENST ID: ENST00000419041
  CDS Start-End: 73-756

SEQ ID NO: 150912 - DNA, 611 bp, Homo sapiens
  Payload ID: 9766
  Gene Symbol: HLA-DMA
  Gene Name: major histocompatibility complex, class II, DM alpha
  ENST ID: ENST00000426176
  CDS Start-End: 105-611
ttgactgacatctccgccccacaagggccccttctcacctggatcctaaagccttccagggggcctccaaagttgccctcggcttggtacgggctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgc

SEQ ID NO: 150913 - DNA, 1126 bp, Homo sapiens; identical to SEQ ID NO: 150905
  Payload ID: 9766
  Gene Symbol: HLA-DMA
  Gene Name: major histocompatibility complex, class II, DM alpha
  Uniprot ID: P28067
  ENST ID: ENST00000452615
  CDS Start-End: 87-872

SEQ ID NO: 150914 - DNA, 611 bp, Homo sapiens; identical to SEQ ID NO: 150912
  Payload ID: 9766
  Gene Symbol: HLA-DMA
  Gene Name: major histocompatibility complex, class II, DM alpha
  ENST ID: ENST00000418042
  CDS Start-End: 105-611

SEQ ID NO: 150915 - DNA, 611 bp, Homo sapiens; identical to SEQ ID NO: 150912
  Payload ID: 9766
  Gene Symbol: HLA-DMA
  Gene Name: major histocompatibility complex, class II, DM alpha
  ENST ID: ENST00000416297
  CDS Start-End: 105-611

SEQ ID NO: 150916 - DNA, 1010 bp, Homo sapiens; identical to SEQ ID NO: 150903
  Payload ID: 9766
  Gene Symbol: HLA-DMA
  Gene Name: major histocompatibility complex, class II, DM alpha
  ENST ID: ENST00000452330
  CDS Start-End: 73-756

SEQ ID NO: 150917 - DNA, 773 bp, Homo sapiens
  Payload ID: 9766
  Gene Symbol: HLA-DMA
  Gene Name: major histocompatibility complex, class II, DM alpha
  ENST ID: ENST00000443447
  CDS Start-End: 26-526
cctacctactgtgtggcaagaaggtatgggtcatgaacagaaccaaggagctgcgctgctacagatgttaccacttctgtggctgctaccccactcctgggccgtccctgaagggtttcctatcgctgaagtgttcacgctgaagcccctggagtttggcaagcccaacactttggtctgttttgtcagtaatctcttcccacccatgctgacagtgaactggcagcatcattccatccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctt

SEQ ID NO: 150918 - DNA, 780 bp, Homo sapiens; identical to SEQ ID NO: 150904
  Payload ID: 9766
  Gene Symbol: HLA-DMA
  Gene Name: major histocompatibility complex, class II, DM alpha
  ENST ID: ENST00000457285
  CDS Start-End: 26-526

SEQ ID NO: 150919 - DNA, 518 bp, Homo sapiens
  Payload ID: 9766
  Gene Symbol: HLA-DMA
  Gene Name: major histocompatibility complex, class II, DM alpha
  ENST ID: ENST00000437285
  CDS Start-End: 12-518
ctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgc

SEQ ID NO: 150920 - DNA, 518 bp, Homo sapiens
  Payload ID: 9766
  Gene Symbol: HLA-DMA
  Gene Name: major histocompatibility complex, class II, DM alpha
  ENST ID: ENST00000441171
  CDS Start-End: 12-518
ctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccatccctgtggaaggatttgggcctacttttgtctcagctgtcgatggactcagcttccaggccttttcttacttaaacttcacaccagaaccttctgacattttctcctgc

SEQ ID NO: 150921 - DNA, 1003 bp, Homo sapiens
  Payload ID: 9766
  Gene Symbol: HLA-DMA
  Gene Name: major histocompatibility complex, class II, DM alpha
  ENST ID: ENST00000420931
  CDS Start-End: 73-756
ctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagtgaactggcagcatcattccatccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctt

SEQ ID NO: 150922 - DNA, 611 bp, Homo sapiens; identical to SEQ ID NO: 150912
  Payload ID: 9766
  Gene Symbol: HLA-DMA
  Gene Name: major histocompatibility complex, class II, DM alpha
  ENST ID: ENST00000422832
  CDS Start-End: 105-611

SEQ ID NO: 150923 - DNA, 1119 bp, Homo sapiens
  Payload ID: 9766
  Gene Symbol: HLA-DMA
  Gene Name: major histocompatibility complex, class II, DM alpha
  ENST ID: ENST00000439054
  CDS Start-End: 87-872
gatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccatccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctt

SEQ ID NO: 150924 - DNA, 1126 bp, Homo sapiens; identical to SEQ ID NO: 150905
  Payload ID: 9766
  Gene Symbol: HLA-DMA
  Gene Name: major histocompatibility complex, class II, DM alpha
  Uniprot ID: P28067
  ENST ID: ENST00000453490
  CDS Start-End: 87-872

SEQ ID NO: 150925 - DNA, 780 bp, Homo sapiens; identical to SEQ ID NO: 150904
  Payload ID: 9766
  Gene Symbol: HLA-DMA
  Gene Name: major histocompatibility complex, class II, DM alpha
  ENST ID: ENST00000452703
  CDS Start-End: 26-526

SEQ ID NO: 150926 - DNA, 871 bp, Homo sapiens
  Payload ID: 9766
  Gene Symbol: HLA-DMA
  Gene Name: major histocompatibility complex, class II, DM alpha
  ENST ID: ENST00000416806
  CDS Start-End: 1-871
gtttcctgctggctgagcgattcctgccaagagcttcaaagaagagggattattttatgcagttatggggtcacttctcccattgctgtctttgggaggcctggtaggttaaggaacagaagacattttgagagacgcttggtgccaatgaagtggctgaagaaatgtctggatacagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtg

SEQ ID NO: 150927 - DNA, 1126 bp, Homo sapiens; identical to SEQ ID NO: 150905
  Payload ID: 9766
  Gene Symbol: HLA-DMA
  Gene Name: major histocompatibility complex, class II, DM alpha
  Uniprot ID: P28067
  ENST ID: ENST00000434337
  CDS Start-End: 87-872

SEQ ID NO: 150928 - DNA, 611 bp, Homo sapiens; identical to SEQ ID NO: 150912
  Payload ID: 9766
  Gene Symbol: HLA-DMA
  Gene Name: major histocompatibility complex, class II, DM alpha
  ENST ID: ENST00000419231
  CDS Start-End: 105-611

SEQ ID NO: 150929 - DNA, 611 bp, Homo sapiens; identical to SEQ ID NO: 150912
  Payload ID: 9766
  Gene Symbol: HLA-DMA
  Gene Name: major histocompatibility complex, class II, DM alpha
  ENST ID: ENST00000458066
  CDS Start-End: 105-611

SEQ ID NO: 150930 - DNA, 871 bp, Homo sapiens
  Payload ID: 9766
  Gene Symbol: HLA-DMA
  Gene Name: major histocompatibility complex, class II, DM alpha
  ENST ID: ENST00000456486
  CDS Start-End: 1-871
gtttcctgctggctgagcgattcctgccaagagcttcaaagaagagggattattttatgcagttatggggtcacttctcccattgctgtctttgggaggcctggtaggttaaggaacagaagacattttgagagacgcttggtgccaatgaagtggctgaagaaatgtctggatacagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccatccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtg

SEQ ID NO: 150931 - DNA, 871 bp, Homo sapiens; identical to SEQ ID NO: 150926
  Payload ID: 9766
  Gene Symbol: HLA-DMA
  Gene Name: major histocompatibility complex, class II, DM alpha
  ENST ID: ENST00000422196
  CDS Start-End: 1-871

SEQ ID NO: 150932 - DNA, 871 bp, Homo sapiens; identical to SEQ ID NO: 150926
  Payload ID: 9766
  Gene Symbol: HLA-DMA
  Gene Name: major histocompatibility complex, class II, DM alpha
  ENST ID: ENST00000456800
  CDS Start-End: 1-871

SEQ ID NO: 150933 - DNA, 780 bp, Homo sapiens; identical to SEQ ID NO: 150904
  Payload ID: 9766
  Gene Symbol: HLA-DMA
  Gene Name: major histocompatibility complex, class II, DM alpha
  ENST ID: ENST00000451753
  CDS Start-End: 26-526

SEQ ID NO: 150934 - DNA, 1126 bp, Homo sapiens; identical to SEQ ID NO: 150905
  Payload ID: 9766
  Gene Symbol: HLA-DMA
  Gene Name: major histocompatibility complex, class II, DM alpha
  Uniprot ID: P28067
  ENST ID: ENST00000441375
  CDS Start-End: 87-872

SEQ ID NO: 150935 - DNA, 871 bp, Homo sapiens; identical to SEQ ID NO: 150926
  Payload ID: 9766
  Gene Symbol: HLA-DMA
  Gene Name: major histocompatibility complex, class II, DM alpha
  ENST ID: ENST00000433630
  CDS Start-End: 1-871

SEQ ID NO: 150936 - DNA, 1010 bp, Homo sapiens; identical to SEQ ID NO: 150903
  Payload ID: 9766
  Gene Symbol: HLA-DMA
  Gene Name: major histocompatibility complex, class II, DM alpha
  ENST ID: ENST00000452434
  CDS Start-End: 73-756

SEQ ID NO: 150937 - DNA, 871 bp, Homo sapiens; identical to SEQ ID NO: 150926
  Payload ID: 9766
  Gene Symbol: HLA-DMA
  Gene Name: major histocompatibility complex, class II, DM alpha
  ENST ID: ENST00000412394
  CDS Start-End: 148-871

SEQ ID NO: 150938 - DNA, 1010 bp, Homo sapiens; identical to SEQ ID NO: 150903
  Payload ID: 9766
  Gene Symbol: HLA-DMA
  Gene Name: major histocompatibility complex, class II, DM alpha
  ENST ID: ENST00000451148
  CDS Start-End: 73-756

SEQ ID NO: 150939 - DNA, 871 bp, Homo sapiens; identical to SEQ ID NO: 150926
  Payload ID: 9766
  Gene Symbol: HLA-DMA
  Gene Name: major histocompatibility complex, class II, DM alpha
  ENST ID: ENST00000454298
  CDS Start-End: 1-871

SEQ ID NO: 150940 - DNA, 780 bp, Homo sapiens; identical to SEQ ID NO: 150904
  Payload ID: 9766
  Gene Symbol: HLA-DMA
  Gene Name: major histocompatibility complex, class II, DM alpha
  ENST ID: ENST00000420299
  CDS Start-End: 26-526

SEQ ID NO: 150941 - DNA, 871 bp, Homo sapiens; identical to SEQ ID NO: 150926
  Payload ID: 9766
  Gene Symbol: HLA-DMA
  Gene Name: major histocompatibility complex, class II, DM alpha
  ENST ID: ENST00000440717
  CDS Start-End: 1-871

SEQ ID NO: 150942 - DNA, 1397 bp, Homo sapiens
  Payload ID: 9767
  Gene Symbol: HLA-DMB
  Gene Name: major histocompatibility complex, class II, DM beta
  Uniprot ID: P28068
  ENST ID: ENST00000383231
  CDS Start-End: 264-1055
atttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150943 - DNA, 1397 bp, Homo sapiens
  Payload ID: 9767
  Gene Symbol: HLA-DMB
  Gene Name: major histocompatibility complex, class II, DM beta
  Uniprot ID: P28068
  ENST ID: ENST00000395312
  CDS Start-End: 264-1055
atttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150944 - DNA, 612 bp, Homo sapiens
  Payload ID: 9767
  Gene Symbol: HLA-DMB
  Gene Name: major histocompatibility complex, class II, DM beta
  ENST ID: ENST00000448590
  CDS Start-End: 87-612
gatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcag

SEQ ID NO: 150945 - DNA, 663 bp, Homo sapiens
  Payload ID: 9767
  Gene Symbol: HLA-DMB
  Gene Name: major histocompatibility complex, class II, DM beta
  ENST ID: ENST00000438510
  CDS Start-End: 1-321
gtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150946 - DNA, 663 bp, Homo sapiens
  Payload ID: 9767
  Gene Symbol: HLA-DMB
  Gene Name: major histocompatibility complex, class II, DM beta
  ENST ID: ENST00000437382
  CDS Start-End: 1-321
gtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150947 - DNA, 663 bp, Homo sapiens
  Payload ID: 9767
  Gene Symbol: HLA-DMB
  Gene Name: major histocompatibility complex, class II, DM beta
  ENST ID: ENST00000435204
  CDS Start-End: 1-321
gtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggagttacactcctcttcctgggtccaattattcagaaggatggcacatttcctagaggcagaatcctacaacttccactccaagtgagaaggagattcaaactcaatgatgctaccatgcctctccaatatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150948 - DNA, 766 bp, Homo sapiens
  Payload ID: 9767
  Gene Symbol: HLA-DMB
  Gene Name: major histocompatibility complex, class II, DM beta
  ENST ID: ENST00000441177
  CDS Start-End: 1-424
gacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagatggcacatttcctagaggcagaatcctacaacttccactccaagtgagaaggagattcaaactcaatgatgctaccatgcctctccaatatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150949 - DNA, 1397 bp, Homo sapiens; identical to SEQ ID NO: 150942
  Payload ID: 9767
  Gene Symbol: HLA-DMB
  Gene Name: major histocompatibility complex, class II, DM beta
  Uniprot ID: P28068
  ENST ID: ENST00000428420
  CDS Start-End: 264-1055

SEQ ID NO: 150950 - DNA, 766 bp, Homo sapiens
  Payload ID: 9767
  Gene Symbol: HLA-DMB
  Gene Name: major histocompatibility complex, class II, DM beta
  ENST ID: ENST00000424874
  CDS Start-End: 1-424
gacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150951 - DNA, 1347 bp, Homo sapiens
  Payload ID: 9767
  Gene Symbol: HLA-DMB
  Gene Name: major histocompatibility complex, class II, DM beta
  ENST ID: ENST00000413617
  CDS Start-End: 215-988
tcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagtgacctcattatctcccttttatttattctgtaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150952 - DNA, 1347 bp, Homo sapiens
  Payload ID: 9767
  Gene Symbol: HLA-DMB
  Gene Name: major histocompatibility complex, class II, DM beta
  ENST ID: ENST00000418759
  CDS Start-End: 215-988
tcccgtgagctggaaggaacagatttaatatctaggggctgggtattcccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagtgacctcattatctcccttttatttattctgtaggatggcacatttcctagaggcagaatcctacaacttccactccaagtgagaaggagattcaaactcaatgatgctaccatgcctctccaatatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150953 - DNA, 1347 bp, Homo sapiens
  Payload ID: 9767
  Gene Symbol: HLA-DMB
  Gene Name: major histocompatibility complex, class II, DM beta
  ENST ID: ENST00000447454
  CDS Start-End: 215-988
tcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagtgacctcattatctcccttttatttattctgtaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150954 - DNA, 766 bp, Homo sapiens
  Payload ID: 9767
  Gene Symbol: HLA-DMB
  Gene Name: major histocompatibility complex, class II, DM beta
  ENST ID: ENST00000448798
  CDS Start-End: 1-424
gacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150955 - DNA, 612 bp, Homo sapiens; identical to SEQ ID NO: 150944
  Payload ID: 9767
  Gene Symbol: HLA-DMB
  Gene Name: major histocompatibility complex, class II, DM beta
  ENST ID: ENST00000415090
  CDS Start-End: 87-612

SEQ ID NO: 150956 - DNA, 1397 bp, Homo sapiens
  Payload ID: 9767
  Gene Symbol: HLA-DMB
  Gene Name: major histocompatibility complex, class II, DM beta
  Uniprot ID: P28068
  ENST ID: ENST00000418107
  CDS Start-End: 264-1055
atttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150957 - DNA, 1347 bp, Homo sapiens; identical to SEQ ID NO: 150953
  Payload ID: 9767
  Gene Symbol: HLA-DMB
  Gene Name: major histocompatibility complex, class II, DM beta
  ENST ID: ENST00000452407
  CDS Start-End: 215-988

SEQ ID NO: 150958 - DNA, 766 bp, Homo sapiens; identical to SEQ ID NO: 150954
  Payload ID: 9767
  Gene Symbol: HLA-DMB
  Gene Name: major histocompatibility complex, class II, DM beta
  ENST ID: ENST00000438310
  CDS Start-End: 1-424

SEQ ID NO: 150959 - DNA, 766 bp, Homo sapiens
  Payload ID: 9767
  Gene Symbol: HLA-DMB
  Gene Name: major histocompatibility complex, class II, DM beta
  ENST ID: ENST00000451921
  CDS Start-End: 1-424
gacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150960 - DNA, 766 bp, Homo sapiens; identical to SEQ ID NO: 150950
  Payload ID: 9767
  Gene Symbol: HLA-DMB
  Gene Name: major histocompatibility complex, class II, DM beta
  ENST ID: ENST00000433242
  CDS Start-End: 1-424

SEQ ID NO: 150961 - DNA, 663 bp, Homo sapiens
  Payload ID: 9767
  Gene Symbol: HLA-DMB
  Gene Name: major histocompatibility complex, class II, DM beta
  ENST ID: ENST00000430115
  CDS Start-End: 1-321
gtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150962 - DNA, 1347 bp, Homo sapiens; identical to SEQ ID NO: 150953
  Payload ID: 9767
  Gene Symbol: HLA-DMB
  Gene Name: major histocompatibility complex, class II, DM beta
  ENST ID: ENST00000428864
  CDS Start-End: 215-988

SEQ ID NO: 150963 - DNA, 612 bp, Homo sapiens; identical to SEQ ID NO: 150944
  Payload ID: 9767
  Gene Symbol: HLA-DMB
  Gene Name: major histocompatibility complex, class II, DM beta
  ENST ID: ENST00000449679
  CDS Start-End: 87-612

SEQ ID NO: 150964 - DNA, 663 bp, Homo sapiens; identical to SEQ ID NO: 150961
  Payload ID: 9767
  Gene Symbol: HLA-DMB
  Gene Name: major histocompatibility complex, class II, DM beta
  ENST ID: ENST00000437583
  CDS Start-End: 1-321

SEQ ID NO: 150965 - DNA, 663 bp, Homo sapiens; identical to SEQ ID NO: 150945
  Payload ID: 9767
  Gene Symbol: HLA-DMB
  Gene Name: major histocompatibility complex, class II, DM beta
  ENST ID: ENST00000413696
  CDS Start-End: 1-321

SEQ ID NO: 150966 - DNA, 663 bp, Homo sapiens; identical to SEQ ID NO: 150945
  Payload ID: 9767
  Gene Symbol: HLA-DMB
  Gene Name: major histocompatibility complex, class II, DM beta
  ENST ID: ENST00000440269
  CDS Start-End: 1-321

SEQ ID NO: 150967 - DNA, 1397 bp, Homo sapiens; identical to SEQ ID NO: 150956
  Payload ID: 9767
  Gene Symbol: HLA-DMB
  Gene Name: major histocompatibility complex, class II, DM beta
  Uniprot ID: P28068
  ENST ID: ENST00000450897
  CDS Start-End: 264-1055

SEQ ID NO: 150968 - DNA, 766 bp, Homo sapiens; identical to SEQ ID NO: 150954
  Payload ID: 9767
  Gene Symbol: HLA-DMB
  Gene Name: major histocompatibility complex, class II, DM beta
  ENST ID: ENST00000413038
  CDS Start-End: 1-424

SEQ ID NO: 150969 - DNA, 612 bp, Homo sapiens; identical to SEQ ID NO: 150944
  Payload ID: 9767
  Gene Symbol: HLA-DMB
  Gene Name: major histocompatibility complex, class II, DM beta
  ENST ID: ENST00000449417
  CDS Start-End: 87-612

SEQ ID NO: 150970 - DNA, 663 bp, Homo sapiens; identical to SEQ ID NO: 150961
  Payload ID: 9767
  Gene Symbol: HLA-DMB
  Gene Name: major histocompatibility complex, class II, DM beta
  ENST ID: ENST00000421456
  CDS Start-End: 1-321

SEQ ID NO: 150971 - DNA, 612 bp, Homo sapiens; identical to SEQ ID NO: 150944
  Payload ID: 9767
  Gene Symbol: HLA-DMB
  Gene Name: major histocompatibility complex, class II, DM beta
  ENST ID: ENST00000435056
  CDS Start-End: 87-612

SEQ ID NO: 150972 - DNA, 766 bp, Homo sapiens; identical to SEQ ID NO: 150950
  Payload ID: 9767
  Gene Symbol: HLA-DMB
  Gene Name: major histocompatibility complex, class II, DM beta
  ENST ID: ENST00000414017
  CDS Start-End: 1-424

SEQ ID NO: 150973 - DNA, 1397 bp, Homo sapiens; identical to SEQ ID NO: 150942
  Payload ID: 9767
  Gene Symbol: HLA-DMB
  Gene Name: major histocompatibility complex, class II, DM beta
  Uniprot ID: P28068
  ENST ID: ENST00000440078
  CDS Start-End: 264-1055

SEQ ID NO: 150974 - DNA, 612 bp, Homo sapiens; identical to SEQ ID NO: 150944
  Payload ID: 9767
  Gene Symbol: HLA-DMB
  Gene Name: major histocompatibility complex, class II, DM beta
  ENST ID: ENST00000430099
  CDS Start-End: 87-612

SEQ ID NO: 150975 - DNA, 1347 bp, Homo sapiens
  Payload ID: 9767
  Gene Symbol: HLA-DMB
  Gene Name: major histocompatibility complex, class II, DM beta
  ENST ID: ENST00000439344
  CDS Start-End: 215-988
tcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagtgacctcattatctcccttttatttattctgtaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150976 - DNA, 1397 bp, Homo sapiens; identical to SEQ ID NO: 150956
  Payload ID: 9767
  Gene Symbol: HLA-DMB
  Gene Name: major histocompatibility complex, class II, DM beta
  Uniprot ID: P28068
  ENST ID: ENST00000412948
  CDS Start-End: 264-1055

SEQ ID NO: 150977 - DNA, 612 bp, Homo sapiens; identical to SEQ ID NO: 150944
  Payload ID: 9767
  Gene Symbol: HLA-DMB
  Gene Name: major histocompatibility complex, class II, DM beta
  ENST ID: ENST00000415927
  CDS Start-End: 87-612

SEQ ID NO: 150978 - DNA, 1397 bp, Homo sapiens
  Payload ID: 9767
  Gene Symbol: HLA-DMB
  Gene Name: major histocompatibility complex, class II, DM beta
  Uniprot ID: P28068
  ENST ID: ENST00000424822
  CDS Start-End: 264-1055
atttgtccctgcctacctagccaatctgtccctgtttgggacactggactcccgtgagctggaaggaacagatttaatatctaggggctgggtattcccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaatatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 150979 - DNA, 1347 bp, Homo sapiens; identical to SEQ ID NO: 150975
  Payload ID: 9767
  Gene Symbol: HLA-DMB
  Gene Name: major histocompatibility complex, class II, DM beta
  ENST ID: ENST00000456428
  CDS Start-End: 215-988

SEQ ID NO: 150980 - DNA, 3489 bp, Homo sapiens
  Payload ID: 9768
  Gene Symbol: HLA-DOA
  Gene Name: major histocompatibility complex, class II, DO alpha
  Uniprot ID: P06340
  ENST ID: ENST00000229829
  CDS Start-End: 77-829
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtgtttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaggacaggctcatggggactccactcctgcctgggtttactctgtatgaagaggccactggtatcctgccatgatgttatctcctttttctacttttccctagagtcccatgcatgataaagagaggcccaaggcttggataaggtggccacttccctcagtggagtcagtcatgttaggtaggaggtggtagagtcggtctgcgaggtatctcgtaagaggggaggtccacctagacacactctaaatatgtggcctagaagattttggtctacttttctgtgaacagaatttaaaacatacaaagagataaatcaccataccacatagtttatgtcaggaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccaggcatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacagggaggctgtcttttctgagatggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaa

SEQ ID NO: 150981 - DNA, 303 bp, Homo sapiens
  Payload ID: 9768
  Gene Symbol: HLA-DOA
  Gene Name: major histocompatibility complex, class II, DO alpha
  ENST ID: ENST00000374813
  CDS Start-End: 44-303
accacacggactgagactgatttgattaaagcaccagagtgtaatggccctcagagcagggctggtcctggggttccacaccctgatgaccctcctgagcccgcaggaggcaggggccaccaaggggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtga

SEQ ID NO: 150982 - DNA, 303 bp, Homo sapiens; identical to SEQ ID NO: 150981
  Payload ID: 9768
  Gene Symbol: HLA-DOA
  Gene Name: major histocompatibility complex, class II, DO alpha
  ENST ID: ENST00000383225
  CDS Start-End: 44-303

SEQ ID NO: 150983 - DNA, 3489 bp, Homo sapiens
  Payload ID: 9768
  Gene Symbol: HLA-DOA
  Gene Name: major histocompatibility complex, class II, DO alpha
  Uniprot ID: P06340
  ENST ID: ENST00000383226
  CDS Start-End: 77-829
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacaaacacacattcttgctctacccaaagctctggctggcagcactaaatgctttggtggtgtttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaggacaggctcatggggactccactcctgcctgggtttactctgtatgaagaggccactggtatcctgccatgatgttatctcctttttctacttttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacagggaggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccattgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttggcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcagaaatcaagatctcaacacaaatgtggctgccaagcactcagccctggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaa

SEQ ID NO: 150984 - DNA, 3489 bp, Homo sapiens; identical to SEQ ID NO: 150980
  Payload ID: 9768
  Gene Symbol: HLA-DOA
  Gene Name: major histocompatibility complex, class II, DO alpha
  Uniprot ID: P06340
  ENST ID: ENST00000438987
  CDS Start-End: 77-829

SEQ ID NO: 150985 - DNA, 3488 bp, Homo sapiens
  Payload ID: 9768
  Gene Symbol: HLA-DOA
  Gene Name: major histocompatibility complex, class II, DO alpha
  Uniprot ID: P06340
  ENST ID: ENST00000426685
  CDS Start-End: 77-829
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctacgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacaaacacacattcttgctctacccaaagctctggctggcagcactaaatgctttggtggtgtttgcactgtgtcctttccaggccttggccagttcttccaggggtgaggcatgtggtgctggggattggcagccgtcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaagacaggctcatggggactccactcctgcctgggtttactctgtatgaagaggccactggtatcctgccatgatgttatctcctttttctactttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacattctaaatatgtggcctagaagattttggtctacttttctgtgaacaaaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacagaactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacaggggggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagggaataagttgaaatcaatgaccagaagaccctgatggaagtggaggaaaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaa

SEQ ID NO: 150986 - DNA, 3488 bp, Homo sapiens
  Payload ID: 9768
  Gene Symbol: HLA-DOA
  Gene Name: major histocompatibility complex, class II, DO alpha
  Uniprot ID: P06340
  ENST ID: ENST00000452598
  CDS Start-End: 77-829
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggtgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctacgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggtctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacaaacacacattcttgctctacccaaagctctggctggcagcactaaatgctttggtggtgtttgcactgtgtcctttccaggccttggccagttcttccaggggtgaggcatgtggtgctggggattggcagccgtcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaagacaggctcatggggactccactcctgcctgggtttactctgtatgaagaggccactggtatcctgccatgatgttatctcctttttctactttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccaggcatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacaggggggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaa

SEQ ID NO: 150987 - DNA, 3488 bp, Homo sapiens; identical to SEQ ID NO: 150986
  Payload ID: 9768
  Gene Symbol: HLA-DOA
  Gene Name: major histocompatibility complex, class II, DO alpha
  Uniprot ID: P06340
  ENST ID: ENST00000426070
  CDS Start-End: 77-829

SEQ ID NO: 150988 - DNA, 303 bp, Homo sapiens
  Payload ID: 9768
  Gene Symbol: HLA-DOA
  Gene Name: major histocompatibility complex, class II, DO alpha
  ENST ID: ENST00000416763
  CDS Start-End: 44-303
accacacggactgagactgatttgattaaagcaccagagtgtaatggccctcagagcagggctggtcctggggttccacaccctgatgaccctcctgagcccgcaggaggcaggggccaccaaggggtgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtga

SEQ ID NO: 150989 - DNA, 303 bp, Homo sapiens; identical to SEQ ID NO: 150981
  Payload ID: 9768
  Gene Symbol: HLA-DOA
  Gene Name: major histocompatibility complex, class II, DO alpha
  ENST ID: ENST00000444109
  CDS Start-End: 44-303

SEQ ID NO: 150990 - DNA, 303 bp, Homo sapiens; identical to SEQ ID NO: 150988
  Payload ID: 9768
  Gene Symbol: HLA-DOA
  Gene Name: major histocompatibility complex, class II, DO alpha
  ENST ID: ENST00000455325
  CDS Start-End: 44-303

SEQ ID NO: 150991 - DNA, 868 bp, Homo sapiens
  Payload ID: 9768
  Gene Symbol: HLA-DOA
  Gene Name: major histocompatibility complex, class II, DO alpha
  ENST ID: ENST00000450833
  CDS Start-End: 25-210
atttgattaaagcaccagagtgtaatggccctcagagcagggctggtcctggggttccacaccctgatgaccctcctgagcccgcaggaggcaggggccaccaaggctgaccacatgggctcctacggaccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgc

SEQ ID NO: 150992 - DNA, 303 bp, Homo sapiens; identical to SEQ ID NO: 150981
  Payload ID: 9768
  Gene Symbol: HLA-DOA
  Gene Name: major histocompatibility complex, class II, DO alpha
  ENST ID: ENST00000418857
  CDS Start-End: 44-303

SEQ ID NO: 150993 - DNA, 303 bp, Homo sapiens
  Payload ID: 9768
  Gene Symbol: HLA-DOA
  Gene Name: major histocompatibility complex, class II, DO alpha
  ENST ID: ENST00000457663
  CDS Start-End: 44-303
accacacggactgagactgatttgattaaagcaccagagtgcaatggccctcagagcagggctggtcctggggttccacaccctgatgaccctcctgagcccgcaggaggcaggggccaccaaggggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtga

SEQ ID NO: 150994 - DNA, 3489 bp, Homo sapiens
  Payload ID: 9768
  Gene Symbol: HLA-DOA
  Gene Name: major histocompatibility complex, class II, DO alpha
  Uniprot ID: P06340
  ENST ID: ENST00000434335
  CDS Start-End: 77-829
cttcttctttacctccgccttgttcctgtcctcaccacacggactgagactgatttgattaaagcaccagagtgcaatggccctcagagcagggctggtcctggggttccacaccctgatgaccctcctgagcccgcaggaggcaggggccaccaaggctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggcgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtatttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaggacaggctcatggggactccactcctgcctgggtttactctgtatgaagaggccactggtatcctgccatgatgttatctcctttttctacttttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacagggaggctgtcttttctgagaaggagtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaa

SEQ ID NO: 150995 - DNA, 868 bp, Homo sapiens
  Payload ID: 9768
  Gene Symbol: HLA-DOA
  Gene Name: major histocompatibility complex, class II, DO alpha
  ENST ID: ENST00000549881
  CDS Start-End: 25-210
atttgattaaagcaccagagtgtaatggccctcagagcagggctggtcctggggttccacaccctgatgaccctcctgagcccgcaggaggcaggggccaccaaggctgaccacatgggctcctacggaccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggtgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctacgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggtctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgc

SEQ ID NO: 150996 - DNA, 868 bp, Homo sapiens
  Payload ID: 9768
  Gene Symbol: HLA-DOA
  Gene Name: major histocompatibility complex, class II, DO alpha
  ENST ID: ENST00000547284
  CDS Start-End: 25-210
atttgattaaagcaccagagtgcaatggccctcagagcagggctggtcctggggttccacaccctgatgaccctcctgagcccgcaggaggcaggggccaccaaggctgaccacatgggctcctacggaccgccttctaccagtcttacggcgcctcgggccagttcacccatgaatttgatgaggaacagctgttctctgtggacctgaagaaaagcgaggccgtgtggcgtctgcctgagtttggcgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgc

SEQ ID NO: 150997 - DNA, 868 bp, Homo sapiens; identical to SEQ ID NO: 150995
  Payload ID: 9768
  Gene Symbol: HLA-DOA
  Gene Name: major histocompatibility complex, class II, DO alpha
  ENST ID: ENST00000546375
  CDS Start-End: 25-210

SEQ ID NO: 150998 - DNA, 868 bp, Homo sapiens; identical to SEQ ID NO: 150991
  Payload ID: 9768
  Gene Symbol: HLA-DOA
  Gene Name: major histocompatibility complex, class II, DO alpha
  ENST ID: ENST00000549845
  CDS Start-End: 25-210

SEQ ID NO: 150999 - DNA, 868 bp, Homo sapiens; identical to SEQ ID NO: 150991
  Payload ID: 9768
  Gene Symbol: HLA-DOA
  Gene Name: major histocompatibility complex, class II, DO alpha
  ENST ID: ENST00000550072
  CDS Start-End: 25-210

SEQ ID NO: 151000 - DNA, 868 bp, Homo sapiens
  Payload ID: 9768
  Gene Symbol: HLA-DOA
  Gene Name: major histocompatibility complex, class II, DO alpha
  ENST ID: ENST00000552368
  CDS Start-End: 25-210
atttgattaaagcaccagagtgtaatggccctcagagcagggctggtcctggggttccacaccctgatgaccctcctgagcccgcaggaggcaggggccaccaaggctgaccacatgggctcctacggaccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctacgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgc

SEQ ID NO: 151001 - DNA, 1372 bp, Homo sapiens
  Payload ID: 9769
  Gene Symbol: HLA-DOB
  Gene Name: major histocompatibility complex, class II, DO beta
  Uniprot ID: P13765
  ENST ID: ENST00000438763
  CDS Start-End: 98-919
gatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 151002 - DNA, 543 bp, Homo sapiens
  Payload ID: 9769
  Gene Symbol: HLA-DOB
  Gene Name: major histocompatibility complex, class II, DO beta
  ENST ID: ENST00000413252
  CDS Start-End: 1-543
gaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacac

SEQ ID NO: 151003 - DNA, 543 bp, Homo sapiens; identical to SEQ ID NO: 151002
  Payload ID: 9769
  Gene Symbol: HLA-DOB
  Gene Name: major histocompatibility complex, class II, DO beta
  ENST ID: ENST00000453971
  CDS Start-End: 1-543

SEQ ID NO: 151004 - DNA, 1372 bp, Homo sapiens
  Payload ID: 9769
  Gene Symbol: HLA-DOB
  Gene Name: major histocompatibility complex, class II, DO beta
  Uniprot ID: P13765
  ENST ID: ENST00000456406
  CDS Start-End: 98-919
gatttatactcttaatgggtactttctgactgaattttatgaactcattctgaagaggctgacgattttactgtctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 151005 - DNA, 543 bp, Homo sapiens; identical to SEQ ID NO: 151002
  Payload ID: 9769
  Gene Symbol: HLA-DOB
  Gene Name: major histocompatibility complex, class II, DO beta
  ENST ID: ENST00000447394
  CDS Start-End: 1-543

SEQ ID NO: 151006 - DNA, 1372 bp, Homo sapiens; identical to SEQ ID NO: 151004
  Payload ID: 9769
  Gene Symbol: HLA-DOB
  Gene Name: major histocompatibility complex, class II, DO beta
  Uniprot ID: P13765
  ENST ID: ENST00000426644
  CDS Start-End: 98-919

SEQ ID NO: 151007 - DNA, 1372 bp, Homo sapiens
  Payload ID: 9769
  Gene Symbol: HLA-DOB
  Gene Name: major histocompatibility complex, class II, DO beta
  Uniprot ID: P13765
  ENST ID: ENST00000454286
  CDS Start-End: 98-919
gatttatactcttaatgggtactttctgactgaattttatgaactcattctgaagaggctgacgattttactgtctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctatttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 151008 - DNA, 543 bp, Homo sapiens
  Payload ID: 9769
  Gene Symbol: HLA-DOB
  Gene Name: major histocompatibility complex, class II, DO beta
  ENST ID: ENST00000439310
  CDS Start-End: 1-543
gaatctgacccgactggattcctccatgactcaaggcacagactctccagaagactttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacac

SEQ ID NO: 151009 - DNA, 1372 bp, Homo sapiens
  Payload ID: 9769
  Gene Symbol: HLA-DOB
  Gene Name: major histocompatibility complex, class II, DO beta
  Uniprot ID: P13765
  ENST ID: ENST00000447178
  CDS Start-End: 98-919
gatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccagaagactttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagtcccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 151010 - DNA, 543 bp, Homo sapiens; identical to SEQ ID NO: 151002
  Payload ID: 9769
  Gene Symbol: HLA-DOB
  Gene Name: major histocompatibility complex, class II, DO beta
  ENST ID: ENST00000455155
  CDS Start-End: 1-543

SEQ ID NO: 151011 - DNA, 1372 bp, Homo sapiens
  Payload ID: 9769
  Gene Symbol: HLA-DOB
  Gene Name: major histocompatibility complex, class II, DO beta
  Uniprot ID: P13765
  ENST ID: ENST00000454969
  CDS Start-End: 98-919
gatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaaatagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 151012 - DNA, 543 bp, Homo sapiens; identical to SEQ ID NO: 151002
  Payload ID: 9769
  Gene Symbol: HLA-DOB
  Gene Name: major histocompatibility complex, class II, DO beta
  ENST ID: ENST00000448690
  CDS Start-End: 1-543

SEQ ID NO: 151013 - DNA, 1188 bp, Homo sapiens
  Payload ID: 9769
  Gene Symbol: HLA-DOB
  Gene Name: major histocompatibility complex, class II, DO beta
  ENST ID: ENST00000472450
  CDS Start-End: 1-735
gtctcatttttttcctttctccagaatgggttctgggtgggtcccctgggtggtggctctgctagtgaatctgacccgactggattcctccatgactcaaggcacagactctccagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 151014 - DNA, 1188 bp, Homo sapiens
  Payload ID: 9769
  Gene Symbol: HLA-DOB
  Gene Name: major histocompatibility complex, class II, DO beta
  ENST ID: ENST00000474604
  CDS Start-End: 26-142
gtctcatttttttcctttctccagaatgggttctgggtgggtcccctgggtggtggctctgctagtgaatctgacccgactggattcctccatgactcaaggcacagactctccagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctatttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 151015 - DNA, 1188 bp, Homo sapiens
  Payload ID: 9769
  Gene Symbol: HLA-DOB
  Gene Name: major histocompatibility complex, class II, DO beta
  ENST ID: ENST00000477041
  CDS Start-End: 26-142
atctcatttttttcctttctccagaatgggttctgggtgggtcccctgggtggtggctctgctagtgaatctgacccgactggattcctccatgactcaaggcacagactctccagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaaatagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 151016 - DNA, 1188 bp, Homo sapiens; identical to SEQ ID NO: 151013
  Payload ID: 9769
  Gene Symbol: HLA-DOB
  Gene Name: major histocompatibility complex, class II, DO beta
  ENST ID: ENST00000463161
  CDS Start-End: 26-142

SEQ ID NO: 151017 - DNA, 1188 bp, Homo sapiens
  Payload ID: 9769
  Gene Symbol: HLA-DOB
  Gene Name: major histocompatibility complex, class II, DO beta
  ENST ID: ENST00000465683
  CDS Start-End: 26-142
atctcatttttttcctttctccagaatgggttctgggtgggtcccctgggtggtggctctgctagtgaatctgacccgactggattcctccatgactcaaggcacagactctccagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagtcccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 151018 - DNA, 1188 bp, Homo sapiens
  Payload ID: 9769
  Gene Symbol: HLA-DOB
  Gene Name: major histocompatibility complex, class II, DO beta
  ENST ID: ENST00000488325
  CDS Start-End: 26-142
atctcatttttttcctttctccagaatgggttctgggtgggtcccctgggtggtggctctgctagtgaatctgacccgactggattcctccatgactcaaggcacagactctccagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 151019 - DNA, 547 bp, Homo sapiens
  Payload ID: 9769
  Gene Symbol: HLA-DOB
  Gene Name: major histocompatibility complex, class II, DO beta
  ENST ID: ENST00000527042
  CDS Start-End: 86-547
taatgggtactttctgactgaattttatgaactcattctgaagaggctgacgattttactgtctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaaggcttctatccaggggatatcaagatcaagtggttcctgaatgggcaggaggagagagctggggtcatgtccactggccctatcaggaatggagactggacc

SEQ ID NO: 151020 - DNA, 1704 bp, Homo sapiens
  Payload ID: 9770
  Gene Symbol: HLA-DPA1
  Gene Name: major histocompatibility complex, class II, DP alpha 1
  Uniprot ID: P20036
  ENST ID: ENST00000374808
  CDS Start-End: 131-913
acgcgtagcattcctgccgtccctggaaaagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcagagcggggagactctgagtcattcttactggaagtctaggaccaggtcacatgtgaatactatttcttgaaggtgtggtttcaacctctgttgccgatgtggttactaaaggttctgatcccacttgaacggaaaggtctgaggatattgattcagtcctgggtttttccctaactacaggatagggtggggtagagaaaggatatttgggggaaattttacttggatgaagattttcttggatgtagtttgaagactgcagtgtttgaagtctctgagggaagagatttggtctgtctggatcaagatttcaggcagattaggattccattcacagcccctgagcttccttcccaaggctgtattgtaattatagcaatatttcatggaggatttttctacatgataaactaagagccaagaaataaaatttttaaaatgccctaa

SEQ ID NO: 151021 - DNA, 1704 bp, Homo sapiens
  Payload ID: 9770
  Gene Symbol: HLA-DPA1
  Gene Name: major histocompatibility complex, class II, DP alpha 1
  Uniprot ID: P20036
  ENST ID: ENST00000383224
  CDS Start-End: 131-913
acgcgtagcattcctgccgtccctggaaaagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagagcccctcactgtcaccttcccgagaataccctaagaccaataaatacttcagtatttcagagcggggagactctgagtcattcttactggaagtctaggaccaggtcacatgtgaatactatttcttgaaggtgtggtttcaacctctgttgccgatgtggttactaaaggttctgatcccacttgaacggaaaggtctgaggatattgattcagtcctgggtttttccctaactacaggatagggtggggtagagaaaggatatttgggggaaattttacttggatgaagattttcttggatgtagtttgaagactgcagtgtttgaagtctctgagggaagagatttggtctgtctggatcaagatttcaggcagattaggattccattcacagcccctgagcttccttcccaaggctgtattgtaattatagcaatatttcatggaggatttttctacatgataaactaagagccaagaaataaattttttaaaatgccctaa

SEQ ID NO: 151022 - DNA, 703 bp, Homo sapiens
  Payload ID: 9770
  Gene Symbol: HLA-DPA1
  Gene Name: major histocompatibility complex, class II, DP alpha 1
  ENST ID: ENST00000452619
  CDS Start-End: 68-703
ctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcata

SEQ ID NO: 151023 - DNA, 703 bp, Homo sapiens; identical to SEQ ID NO: 151022
  Payload ID: 9770
  Gene Symbol: HLA-DPA1
  Gene Name: major histocompatibility complex, class II, DP alpha 1
  ENST ID: ENST00000437676
  CDS Start-End: 68-703

SEQ ID NO: 151024 - DNA, 918 bp, Homo sapiens
  Payload ID: 9770
  Gene Symbol: HLA-DPA1
  Gene Name: major histocompatibility complex, class II, DP alpha 1
  ENST ID: ENST00000441483
  CDS Start-End: 291-918
gcacgagctcctcccggttgtagatgtatctctccaggaagcgctgtgtcccattaaacgcgtagcattcctgccgtccctggaaaagcaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactggg

SEQ ID NO: 151025 - DNA, 703 bp, Homo sapiens; identical to SEQ ID NO: 151022
  Payload ID: 9770
  Gene Symbol: HLA-DPA1
  Gene Name: major histocompatibility complex, class II, DP alpha 1
  ENST ID: ENST00000447657
  CDS Start-End: 68-703

SEQ ID NO: 151026 - DNA, 918 bp, Homo sapiens
  Payload ID: 9770
  Gene Symbol: HLA-DPA1
  Gene Name: major histocompatibility complex, class II, DP alpha 1
  ENST ID: ENST00000453337
  CDS Start-End: 291-918
gcgcgaactcctcccggttgtagatgtatctctccaggaagcgctgtgtcccattaaacgcgtagcattcctgccgtccctggaaaagcaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactggg

SEQ ID NO: 151027 - DNA, 305 bp, Homo sapiens
  Payload ID: 9770
  Gene Symbol: HLA-DPA1
  Gene Name: major histocompatibility complex, class II, DP alpha 1
  ENST ID: ENST00000439867
  CDS Start-End: 237-305
gtcgaagcgcacgagctcctcccggttgtagatgtatctctccaggaagcgctgtgtcccattaaacgcgtagcattcctgccgtccctggaaaaggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctg

SEQ ID NO: 151028 - DNA, 1375 bp, Homo sapiens
  Payload ID: 9770
  Gene Symbol: HLA-DPA1
  Gene Name: major histocompatibility complex, class II, DP alpha 1
  ENST ID: ENST00000455869
  CDS Start-End: 1-385
caacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgggaatgtaaagaggaggccctaggatttgtagaatgtaaggaagggaggaaaaattcaatctgataagtgttcattgatcttctaatgggttaaaagcattcagccacataacaacaacaacaccgataactaactgagtagttaatatggtcaggcgctattctgaggatttacatttattaactcactttattctcacacatagtctttgaggtaggtactattattttcactatttcacatgagagatacttacatctttttacatacacagagactttaagcactttgatcaagttcccacagctatgaagtagtagggctagcttccaatccagaaagtctggatccaagactgtttatccactgtcctattcaccctattttgtgaaggaaaagaccaagttcaaattctccagagtccattgccaaataatggagtcagatctatatttctatacataattacaacacagtgtggtgggtgcctgtaactacttactgtctctacttggactcattccatggcaatgttcacacaaaaaatgcccctccagagatcttacaggtttctatttatcataacactcaccatgctttatatttttatatgttttgggaattctcttagcattagacagtgaacttccatgcagatgaccacatctaattcattattattattgttattcatgctggacctcaggtacaaaaggttaagaacttctcagttcattatatgatcatcattggtgcctccgagctctctctctctcccttgatttatttggtcccttttatctccagtccttactcccatatctaacctcttacccctacctcataggtaaacattttaatgaatttgatgtttccttttatttgcatagatcctctgtaatatgtagtagtgtccagtgtacatgtatttttaattaaccaaaatggcattaaattatagatctaattttgta

SEQ ID NO: 151029 - DNA, 1375 bp, Homo sapiens
  Payload ID: 9770
  Gene Symbol: HLA-DPA1
  Gene Name: major histocompatibility complex, class II, DP alpha 1
  ENST ID: ENST00000429960
  CDS Start-End: 1-385
caacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgggaatgtaaagaggaggccctaggatttgtagaatgtaaggaagggaggaaaaattcaatctgataagtgttcattgatcttctaatgggttaaaagcattcagccacataacaacaacaacaccgataactaactgagtagttaatatggtcaggcgctattctgaggatttacatttattaactcactttattctcacacatagtctttgaggtaggtactattattttcactatttcacatgagagatacttacatctttttacatacacagagactttaagcactttgatcaagttcccacagctatgaagtagtagggctagcttccaatccagaaagtctggatccaagactgtttatccactgtcctattcaccctattttgtgaaggaaaagaccaagttcaaattctccagagtccattgccaaataatggagtcagatctatatttctatacataattacaacacagtgtggtgggtgcctgtaactacttactgtctctacttggactcattccatggcaatgttcacacaaaaaatgcctctccagagatcttacaggtttctatttatcataacactcaccatgctttatatttttatatgttttgggaattctcttagcattagacagtgaacttccatgcagatgaccacatctaattcattattattattgttattcatgctggacctcaggtacaaaaggttaagaacttctcagttcattatatgatcatcattggtgcctccgagctctctctctctcccttgatttatttggtcccttttatctccagtccttactcccatatctaacctcttacccctacctcataggtaaacattttaatgaatttgatgtttccttttatttgcatagatcctctgtaatatgtagtagtgtccagtgtacatgtatttttaattaaccaaaatggcattaaattatagatctaattttgta

SEQ ID NO: 151030 - DNA, 1704 bp, Homo sapiens; identical to SEQ ID NO: 151020
  Payload ID: 9770
  Gene Symbol: HLA-DPA1
  Gene Name: major histocompatibility complex, class II, DP alpha 1
  Uniprot ID: P20036
  ENST ID: ENST00000419277
  CDS Start-End: 131-913

SEQ ID NO: 151031 - DNA, 1375 bp, Homo sapiens; identical to SEQ ID NO: 151029
  Payload ID: 9770
  Gene Symbol: HLA-DPA1
  Gene Name: major histocompatibility complex, class II, DP alpha 1
  ENST ID: ENST00000419452
  CDS Start-End: 1-385

SEQ ID NO: 151032 - DNA, 703 bp, Homo sapiens; identical to SEQ ID NO: 151022
  Payload ID: 9770
  Gene Symbol: HLA-DPA1
  Gene Name: major histocompatibility complex, class II, DP alpha 1
  ENST ID: ENST00000439393
  CDS Start-End: 68-703

SEQ ID NO: 151033 - DNA, 305 bp, Homo sapiens
  Payload ID: 9770
  Gene Symbol: HLA-DPA1
  Gene Name: major histocompatibility complex, class II, DP alpha 1
  ENST ID: ENST00000427518
  CDS Start-End: 237-305
gtcgaagcgcacgaactcctcccggttgtagatgtatctctccaggaagcgctgtgtcccattaaacgcgtagcattcctgccgtccctggaaaaggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctg

SEQ ID NO: 151034 - DNA, 1375 bp, Homo sapiens
  Payload ID: 9770
  Gene Symbol: HLA-DPA1
  Gene Name: major histocompatibility complex, class II, DP alpha 1
  ENST ID: ENST00000453314
  CDS Start-End: 1-385
caacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgggaatgtaaagaggaggccctaggatttgtagaatgtaaggaagggaggaaaaattcaatctgataagtgttcattgatcttctaatgggttaaaagcattcagccacataacaacaacaataccgataactaactgagtagttaatatggtcaggcgctattctgaggatttacatttattaactcactttattctcacacatagtctttgaggtaggtactattattttcactatttcacatgagagatacttacatctttttacatacacagagactttaagcactttgatcaagttcccacagctatgaagtagtagggctagcttccaatccagaaagtctggatccaagactgtttatccactgtcctattcaccctattttgtgaaggaaaagaccaagttcaaattctccagagtccattgccaaataatggagtcagatctatatttctatacataattacaacacagtgtggtgggtgcctgtaactacttactgtctctacttggactcattccatggcaatgttcacacaaaaaatgcccctccagagatcttacaggtttctatttatcataacactcaccatgctttatatttttatatgttttgggaattctcttagcattagacagtgaacttccatgcagatgaccacatctaattcattattattattgttattcatgctggacctcaggtacaaaaggttaagaacttctcagttcattatatgatcatcattggtgcctccgagctctctctctctcccttgatttatttggtcccttttatctccagtccttactcccatatctaacctcttacccctacctcataggtaaacattttaatgaatttgatgtttccttttatttgcatagatcctctgtaatatgtagtagtgtccagtgtacatgtatttttaattaaccaaaatggcattaaattatagatctaattttgta

SEQ ID NO: 151035 - DNA, 1704 bp, Homo sapiens; identical to SEQ ID NO: 151020
  Payload ID: 9770
  Gene Symbol: HLA-DPA1
  Gene Name: major histocompatibility complex, class II, DP alpha 1
  Uniprot ID: P20036
  ENST ID: ENST00000454805
  CDS Start-End: 131-913

SEQ ID NO: 151036 - DNA, 1375 bp, Homo sapiens; identical to SEQ ID NO: 151028
  Payload ID: 9770
  Gene Symbol: HLA-DPA1
  Gene Name: major histocompatibility complex, class II, DP alpha 1
  ENST ID: ENST00000414003
  CDS Start-End: 1-385

SEQ ID NO: 151037 - DNA, 1704 bp, Homo sapiens; identical to SEQ ID NO: 151020
  Payload ID: 9770
  Gene Symbol: HLA-DPA1
  Gene Name: major histocompatibility complex, class II, DP alpha 1
  Uniprot ID: P20036
  ENST ID: ENST00000443117
  CDS Start-End: 131-913

SEQ ID NO: 151038 - DNA, 305 bp, Homo sapiens
  Payload ID: 9770
  Gene Symbol: HLA-DPA1
  Gene Name: major histocompatibility complex, class II, DP alpha 1
  ENST ID: ENST00000417724
  CDS Start-End: 237-305
gtcgaagcgcgcgaactcctcccggttgtagatgtatctctccaggaagcgctgtgtcccattaaacgcgtagcattcctgccgtccctggaaaaggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctg

SEQ ID NO: 151039 - DNA, 918 bp, Homo sapiens
  Payload ID: 9770
  Gene Symbol: HLA-DPA1
  Gene Name: major histocompatibility complex, class II, DP alpha 1
  ENST ID: ENST00000414177
  CDS Start-End: 291-918
gcacgaactcctcccggttgtagatgtatctctccaggaagcgctgtgtcccattaaacgcgtagcattcctgccgtccctggaaaagcaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactggg

SEQ ID NO: 151040 - DNA, 918 bp, Homo sapiens
  Payload ID: 9770
  Gene Symbol: HLA-DPA1
  Gene Name: major histocompatibility complex, class II, DP alpha 1
  ENST ID: ENST00000425105
  CDS Start-End: 291-918
gcacgaactcctcccggttgtagatgtatctctccaggaagcgctgtgtcccattaaacgcgtagcattcctgccgtaactggtacaccaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactggg

SEQ ID NO: 151041 - DNA, 918 bp, Homo sapiens; identical to SEQ ID NO: 151039
  Payload ID: 9770
  Gene Symbol: HLA-DPA1
  Gene Name: major histocompatibility complex, class II, DP alpha 1
  ENST ID: ENST00000439571
  CDS Start-End: 291-918

SEQ ID NO: 151042 - DNA, 305 bp, Homo sapiens; identical to SEQ ID NO: 151033
  Payload ID: 9770
  Gene Symbol: HLA-DPA1
  Gene Name: major histocompatibility complex, class II, DP alpha 1
  ENST ID: ENST00000413109
  CDS Start-End: 237-305

SEQ ID NO: 151043 - DNA, 1375 bp, Homo sapiens; identical to SEQ ID NO: 151028
  Payload ID: 9770
  Gene Symbol: HLA-DPA1
  Gene Name: major histocompatibility complex, class II, DP alpha 1
  ENST ID: ENST00000442259
  CDS Start-End: 1-385

SEQ ID NO: 151044 - DNA, 1375 bp, Homo sapiens; identical to SEQ ID NO: 151028
  Payload ID: 9770
  Gene Symbol: HLA-DPA1
  Gene Name: major histocompatibility complex, class II, DP alpha 1
  ENST ID: ENST00000428180
  CDS Start-End: 1-385

SEQ ID NO: 151045 - DNA, 703 bp, Homo sapiens; identical to SEQ ID NO: 151022
  Payload ID: 9770
  Gene Symbol: HLA-DPA1
  Gene Name: major histocompatibility complex, class II, DP alpha 1
  ENST ID: ENST00000437123
  CDS Start-End: 68-703

SEQ ID NO: 151046 - DNA, 1375 bp, Homo sapiens; identical to SEQ ID NO: 151028
  Payload ID: 9770
  Gene Symbol: HLA-DPA1
  Gene Name: major histocompatibility complex, class II, DP alpha 1
  ENST ID: ENST00000437811
  CDS Start-End: 1-385

SEQ ID NO: 151047 - DNA, 1626 bp, Homo sapiens
  Payload ID: 9770
  Gene Symbol: HLA-DPA1
  Gene Name: major histocompatibility complex, class II, DP alpha 1
  Uniprot ID: P20036
  ENST ID: ENST00000415247
  CDS Start-End: 53-835
gttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcagagcggggagactctgagtcattcttactggaagtctaggaccaggtcacatgtgaatactatttcttgaaggtgtggtttcaacctctgttgccgatgtggttactaaaggttctgatcccacttgaacggaaaggtctgaggatattgattcagtcctgggtttttccctaactacaggatagggtggggtagagaaaggatatttgggggaaattttacttggatgaagattttcttggatgtagtttgaagactgcagtgtttgaagtctctgagggaagagatttggtctgtctggatcaagatttcaggcagattaggattccattcacagcccctgagcttccttcccaaggctgtattgtaattatagcaatatttcatggaggatttttctacatgataaactaagagccaagaaataaaatttttaaaatgccctaa

SEQ ID NO: 151048 - DNA, 1704 bp, Homo sapiens; identical to SEQ ID NO: 151021
  Payload ID: 9770
  Gene Symbol: HLA-DPA1
  Gene Name: major histocompatibility complex, class II, DP alpha 1
  Uniprot ID: P20036
  ENST ID: ENST00000422504
  CDS Start-End: 131-913

SEQ ID NO: 151049 - DNA, 305 bp, Homo sapiens
  Payload ID: 9770
  Gene Symbol: HLA-DPA1
  Gene Name: major histocompatibility complex, class II, DP alpha 1
  ENST ID: ENST00000448742
  CDS Start-End: 237-305
gtcgaagcgcacgaactcctcccggttgtagatgtatctctccaggaagcgctgtgtcccattaaacgcgtagcattcctgccgtaactggtacacgtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctg

SEQ ID NO: 151050 - DNA, 305 bp, Homo sapiens; identical to SEQ ID NO: 151033
  Payload ID: 9770
  Gene Symbol: HLA-DPA1
  Gene Name: major histocompatibility complex, class II, DP alpha 1
  ENST ID: ENST00000432811
  CDS Start-End: 237-305

SEQ ID NO: 151051 - DNA, 918 bp, Homo sapiens; identical to SEQ ID NO: 151039
  Payload ID: 9770
  Gene Symbol: HLA-DPA1
  Gene Name: major histocompatibility complex, class II, DP alpha 1
  ENST ID: ENST00000456525
  CDS Start-End: 291-918

SEQ ID NO: 151052 - DNA, 918 bp, Homo sapiens; identical to SEQ ID NO: 151026
  Payload ID: 9770
  Gene Symbol: HLA-DPA1
  Gene Name: major histocompatibility complex, class II, DP alpha 1
  ENST ID: ENST00000436183
  CDS Start-End: 291-918

SEQ ID NO: 151053 - DNA, 703 bp, Homo sapiens; identical to SEQ ID NO: 151022
  Payload ID: 9770
  Gene Symbol: HLA-DPA1
  Gene Name: major histocompatibility complex, class II, DP alpha 1
  ENST ID: ENST00000441306
  CDS Start-End: 68-703

SEQ ID NO: 151054 - DNA, 305 bp, Homo sapiens; identical to SEQ ID NO: 151038
  Payload ID: 9770
  Gene Symbol: HLA-DPA1
  Gene Name: major histocompatibility complex, class II, DP alpha 1
  ENST ID: ENST00000423630
  CDS Start-End: 237-305

SEQ ID NO: 151055 - DNA, 305 bp, Homo sapiens; identical to SEQ ID NO: 151038
  Payload ID: 9770
  Gene Symbol: HLA-DPA1
  Gene Name: major histocompatibility complex, class II, DP alpha 1
  ENST ID: ENST00000448154
  CDS Start-End: 237-305

SEQ ID NO: 151056 - DNA, 703 bp, Homo sapiens; identical to SEQ ID NO: 151022
  Payload ID: 9770
  Gene Symbol: HLA-DPA1
  Gene Name: major histocompatibility complex, class II, DP alpha 1
  ENST ID: ENST00000515346
  CDS Start-End: 68-703

SEQ ID NO: 151057 - DNA, 918 bp, Homo sapiens; identical to SEQ ID NO: 151026
  Payload ID: 9770
  Gene Symbol: HLA-DPA1
  Gene Name: major histocompatibility complex, class II, DP alpha 1
  ENST ID: ENST00000512750
  CDS Start-End: 291-918

SEQ ID NO: 151058 - DNA, 1704 bp, Homo sapiens; identical to SEQ ID NO: 151020
  Payload ID: 9770
  Gene Symbol: HLA-DPA1
  Gene Name: major histocompatibility complex, class II, DP alpha 1
  Uniprot ID: P20036
  ENST ID: ENST00000515317
  CDS Start-End: 131-913

SEQ ID NO: 151059 - DNA, 1770 bp, Homo sapiens
  Payload ID: 9770
  Gene Symbol: HLA-DPA1
  Gene Name: major histocompatibility complex, class II, DP alpha 1
  Uniprot ID: P20036
  ENST ID: ENST00000617497
  CDS Start-End: 199-981
gctgtcgaagcgcacgaactcctcccggttgtagatgtatctctccaggaagcgctgtgtcccattaaacgcgtagcattcctgccgtaactggtacactgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcagagcggggagactctgagtcattcttactggaagtctaggaccaggtcacatgtgaatactatttcttgaaggtgtggtttcaacctctgttgccgatgtggttactaaaggttctgatcccacttgaacggaaaggtctgaggatattgattcagtcctgggtttttccctaactacaggatagggtggggtagagaaaggatatttgggggaaattttacttggatgaagattttcttggatgtagtttgaagactgcagtgtttgaagtctctgagggaagagatttggtctgtctggatcaagatttcaggcagattaggattccattcacagcccctgagcttccttcccaaggctgtattgtaattatagcaatatttcatggaggatttttctacatgataaactaagagccaagaaataaaatttttaaaatgccct

SEQ ID NO: 151060 - DNA, 1560 bp, Homo sapiens
  Payload ID: 9771
  Gene Symbol: HLA-DPB1
  Gene Name: major histocompatibility complex, class II, DP beta 1
  ENST ID: ENST00000383102
  CDS Start-End: 117-893
gtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgttttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccgtattcccacagcactaattcaacatatatcttactgagagcatgttttatcattaccattaagaagttaaatgaacatcagaatttaaaatcataaatataatctaatacactttaa

SEQ ID NO: 151061 - DNA, 1424 bp, Homo sapiens
  Payload ID: 9771
  Gene Symbol: HLA-DPB1
  Gene Name: major histocompatibility complex, class II, DP beta 1
  ENST ID: ENST00000399491
  CDS Start-End: 71-757
gagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctgggcgggcccatgaccctgcagcgccgaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 151062 - DNA, 1560 bp, Homo sapiens
  Payload ID: 9771
  Gene Symbol: HLA-DPB1
  Gene Name: major histocompatibility complex, class II, DP beta 1
  Uniprot ID: P04440
  ENST ID: ENST00000399500
  CDS Start-End: 117-893
gtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 151063 - DNA, 688 bp, Homo sapiens
  Payload ID: 9771
  Gene Symbol: HLA-DPB1
  Gene Name: major histocompatibility complex, class II, DP beta 1
  ENST ID: ENST00000402095
  CDS Start-End: 1-688
aaacaggcctggagaggctctgcgacccgcttaggaccacagaactcgggacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaag

SEQ ID NO: 151064 - DNA, 1424 bp, Homo sapiens
  Payload ID: 9771
  Gene Symbol: HLA-DPB1
  Gene Name: major histocompatibility complex, class II, DP beta 1
  ENST ID: ENST00000447783
  CDS Start-End: 71-757
gagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcagcgccgaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 151065 - DNA, 688 bp, Homo sapiens
  Payload ID: 9771
  Gene Symbol: HLA-DPB1
  Gene Name: major histocompatibility complex, class II, DP beta 1
  ENST ID: ENST00000450474
  CDS Start-End: 1-688
aaacaggcctggagaggctctgcgacccgcttaggaccacagaactcgttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaag

SEQ ID NO: 151066 - DNA, 1560 bp, Homo sapiens
  Payload ID: 9771
  Gene Symbol: HLA-DPB1
  Gene Name: major histocompatibility complex, class II, DP beta 1
  Uniprot ID: P04440
  ENST ID: ENST00000454006
  CDS Start-End: 117-893
gtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 151067 - DNA, 1361 bp, Homo sapiens
  Payload ID: 9771
  Gene Symbol: HLA-DPB1
  Gene Name: major histocompatibility complex, class II, DP beta 1
  ENST ID: ENST00000445925
  CDS Start-End: 1-707
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaaggtgagaaagcctgcaggttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 151068 - DNA, 1361 bp, Homo sapiens
  Payload ID: 9771
  Gene Symbol: HLA-DPB1
  Gene Name: major histocompatibility complex, class II, DP beta 1
  ENST ID: ENST00000411722
  CDS Start-End: 1-707
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcatggatagtcctgtcaccgtggagtggaaggcacagtctgattctgcccggagtaagacattgacgggagctgggggcttcgtgctggggctcatcatctgtggagtgggcatcttcatgcacaggaggagcaagaaaggtgagaaagcctgcaggttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 151069 - DNA, 688 bp, Homo sapiens
  Payload ID: 9771
  Gene Symbol: HLA-DPB1
  Gene Name: major histocompatibility complex, class II, DP beta 1
  ENST ID: ENST00000445702
  CDS Start-End: 1-688
aaacaggcctggagaggctctgcgacccgcttaggaccacagaactcgggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcatggatagtcctgtcaccgtggagtggaaggcacagtctgattctgcccggagtaagacattgacgggagctgggggcttcgtgctggggctcatcatctgtggagtgggcatcttcatgcacaggaggagcaagaaag

SEQ ID NO: 151070 - DNA, 688 bp, Homo sapiens
  Payload ID: 9771
  Gene Symbol: HLA-DPB1
  Gene Name: major histocompatibility complex, class II, DP beta 1
  ENST ID: ENST00000456386
  CDS Start-End: 1-688
aaacaggcctggagaggctctgcgacccgcttaggaccacagaactcgggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaag

SEQ ID NO: 151071 - DNA, 1424 bp, Homo sapiens
  Payload ID: 9771
  Gene Symbol: HLA-DPB1
  Gene Name: major histocompatibility complex, class II, DP beta 1
  ENST ID: ENST00000444931
  CDS Start-End: 71-757
gagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 151072 - DNA, 1560 bp, Homo sapiens
  Payload ID: 9771
  Gene Symbol: HLA-DPB1
  Gene Name: major histocompatibility complex, class II, DP beta 1
  Uniprot ID: P04440
  ENST ID: ENST00000425130
  CDS Start-End: 117-893
gtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcatggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 151073 - DNA, 688 bp, Homo sapiens; identical to SEQ ID NO: 151069
  Payload ID: 9771
  Gene Symbol: HLA-DPB1
  Gene Name: major histocompatibility complex, class II, DP beta 1
  ENST ID: ENST00000441678
  CDS Start-End: 1-688

SEQ ID NO: 151074 - DNA, 1424 bp, Homo sapiens; identical to SEQ ID NO: 151071
  Payload ID: 9771
  Gene Symbol: HLA-DPB1
  Gene Name: major histocompatibility complex, class II, DP beta 1
  ENST ID: ENST00000411424
  CDS Start-End: 71-757

SEQ ID NO: 151075 - DNA, 1560 bp, Homo sapiens
  Payload ID: 9771
  Gene Symbol: HLA-DPB1
  Gene Name: major histocompatibility complex, class II, DP beta 1
  ENST ID: ENST00000415996
  CDS Start-End: 117-893
gtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 151076 - DNA, 1361 bp, Homo sapiens
  Payload ID: 9771
  Gene Symbol: HLA-DPB1
  Gene Name: major histocompatibility complex, class II, DP beta 1
  ENST ID: ENST00000416804
  CDS Start-End: 1-707
agaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaaggtgagaaagcctgcaggttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 151077 - DNA, 688 bp, Homo sapiens
  Payload ID: 9771
  Gene Symbol: HLA-DPB1
  Gene Name: major histocompatibility complex, class II, DP beta 1
  ENST ID: ENST00000415438
  CDS Start-End: 1-688
aaacaggcctggagaggctctgcgacccgcttaggaccacagaactcgggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaag

SEQ ID NO: 151078 - DNA, 1424 bp, Homo sapiens
  Payload ID: 9771
  Gene Symbol: HLA-DPB1
  Gene Name: major histocompatibility complex, class II, DP beta 1
  ENST ID: ENST00000411558
  CDS Start-End: 71-757
gagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcatggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 151079 - DNA, 1361 bp, Homo sapiens; identical to SEQ ID NO: 151076
  Payload ID: 9771
  Gene Symbol: HLA-DPB1
  Gene Name: major histocompatibility complex, class II, DP beta 1
  ENST ID: ENST00000447674
  CDS Start-End: 1-707

SEQ ID NO: 151080 - DNA, 1560 bp, Homo sapiens; identical to SEQ ID NO: 151066
  Payload ID: 9771
  Gene Symbol: HLA-DPB1
  Gene Name: major histocompatibility complex, class II, DP beta 1
  Uniprot ID: P04440
  ENST ID: ENST00000433800
  CDS Start-End: 117-893

SEQ ID NO: 151081 - DNA, 1560 bp, Homo sapiens; identical to SEQ ID NO: 151066
  Payload ID: 9771
  Gene Symbol: HLA-DPB1
  Gene Name: major histocompatibility complex, class II, DP beta 1
  Uniprot ID: P04440
  ENST ID: ENST00000418931
  CDS Start-End: 117-893

SEQ ID NO: 151082 - DNA, 1361 bp, Homo sapiens
  Payload ID: 9771
  Gene Symbol: HLA-DPB1
  Gene Name: major histocompatibility complex, class II, DP beta 1
  ENST ID: ENST00000432661
  CDS Start-End: 1-707
agaattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaaggtgagaaagcctgcaggttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaa

SEQ ID NO: 151083 - DNA, 688 bp, Homo sapiens; identical to SEQ ID NO: 151070
  Payload ID: 9771
  Gene Symbol: HLA-DPB1
  Gene Name: major histocompatibility complex, class II, DP beta 1
  ENST ID: ENST00000418444
  CDS Start-End: 1-688

SEQ ID NO: 151084 - DNA, 1361 bp, Homo sapiens; identical to SEQ ID NO: 151068
  Payload ID: 9771
  Gene Symbol: HLA-DPB1
  Gene Name: major histocompatibility complex, class II, DP beta 1
  ENST ID: ENST00000455122
  CDS Start-End: 1-707

SEQ ID NO: 151085 - DNA, 1424 bp, Homo sapiens; identical to SEQ ID NO: 151078
  Payload ID: 9771
  Gene Symbol: HLA-DPB1
  Gene Name: major histocompatibility complex, class II, DP beta 1
  ENST ID: ENST00000441981
  CDS Start-End: 71-757

SEQ ID NO: 151086 - DNA, 688 bp, Homo sapiens; identical to SEQ ID NO: 151070
  Payload ID: 9771
  Gene Symbol: HLA-DPB1
  Gene Name: major histocompatibility complex, class II, DP beta 1
  ENST ID: ENST00000428835
  CDS Start-End: 1-688

SEQ ID NO: 151087 - DNA, 1424 bp, Homo sapiens
  Payload ID: 9771
  Gene Symbol: HLA-DPB1
  Gene Name: major histocompatibility complex, class II, DP beta 1
  ENST ID: ENST00000441857
  CDS Start-End: 71-757
gagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcagcgccgaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgttttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccgtattcccacagcactaattcaacatatatcttactgagagcatgttttatcattaccattaagaagttaaatgaacatcagaatttaaaatcataaatataatctaatacactttaa

SEQ ID NO: 151088 - DNA, 1560 bp, Homo sapiens; identical to SEQ ID NO: 151072
  Payload ID: 9771
  Gene Symbol: HLA-DPB1
  Gene Name: major histocompatibility complex, class II, DP beta 1
  Uniprot ID: P04440
  ENST ID: ENST00000411749
  CDS Start-End: 117-893

SEQ ID NO: 151089 - DNA, 1361 bp, Homo sapiens; identical to SEQ ID NO: 151076
  Payload ID: 9771
  Gene Symbol: HLA-DPB1
  Gene Name: major histocompatibility complex, class II, DP beta 1
  ENST ID: ENST00000458614
  CDS Start-End: 1-707

SEQ ID NO: 151090 - DNA, 1361 bp, Homo sapiens
  Payload ID: 9771
  Gene Symbol: HLA-DPB1
  Gene Name: major histocompatibility complex, class II, DP beta 1
  ENST ID: ENST00000434121
  CDS Start-End: 1-707
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaaggtgagaaagcctgcaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgttttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccgtattcccacagcactaattcaacatatatcttactgagagcatgttttatcattaccattaagaagttaaatgaacatcagaatttaaaatcataaatataatctaatacactttaa

SEQ ID NO: 151091 - DNA, 1591 bp, Homo sapiens
  Payload ID: 9772
  Gene Symbol: HLA-DQA1
  Gene Name: major histocompatibility complex, class II, DQ alpha 1
  Uniprot ID: P01909
  ENST ID: ENST00000343139
  CDS Start-End: 103-870
ggcagggtttggtttgggtgtcttcagatttccttgtcttgaggtcctcacaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtgaatcccatcctggaagggaaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaaagacatgcctggggtaagccacccggctacctaattcctcagtaacctccatctaaaatctccaaggaagcaataaattccttttatgagatctatgtcaaatttttccatctttcatccagggctgactgaaactatggctaataattggggtactcttatgtttcaatccaatttaacctcatttcccagatcatttttcatgtccagtaacacagaagccaccaagtacagtatagcctgataatatgttgatttcttagctgacattaatatttcttgcttccttgtgttcccacccttggcactgccacccacccctcaattcaggcaacaatgaaattaatggataccgtctgcccttggcccagaattgttatagcaaaaattttagaaccaaaaaataagtctgtactaatttcaatgtggcttttaaaagtatgacagagaaataagttaggataaaggaaatttgaatctca

SEQ ID NO: 151092 - DNA, 1060 bp, Homo sapiens
  Payload ID: 9772
  Gene Symbol: HLA-DQA1
  Gene Name: major histocompatibility complex, class II, DQ alpha 1
  Uniprot ID: P01909
  ENST ID: ENST00000374949
  CDS Start-End: 40-807
gctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtgaatcccatcctggaagggaaggtaagattgagactggttacagttgaagcggcagtatgaaaggaaggaaagtgggagggcgttgtggacatgaatgtggttgaaagttgtaggggaattgggaagtggcatgatgatgacacaggagccccctcggacccattgatctcatgtctgccctgttgcaggtgcatcgccatctacaggagcagaagaatggacttgctaaatgacctagcactattctctggccc

SEQ ID NO: 151093 - DNA, 1522 bp, Homo sapiens
  Payload ID: 9772
  Gene Symbol: HLA-DQA1
  Gene Name: major histocompatibility complex, class II, DQ alpha 1
  Uniprot ID: P01909
  ENST ID: ENST00000383251
  CDS Start-End: 103-867
ggcagggtttggtttgggtgtcttcagattgccttgtctcgaggtcctcacaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtcttcatcatccgaggcctgcgttcagttggtgcttccagacaccaagggcccttgtgaatcccatcctggaatggaaggtgcatcgccatctacaggagcagaagagtggacttgctacatgacctagcattattttctggccccatttatcatatcccttttctcctccaaatgtttctcctctcacctcttctgtgggacttaaattgctatatctgctcagagctcacaaatgcctttgaattatttccctgacttcctgatttttttcttcttaagtgttacctactaagagttgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttaacatcatttaccagatcatttgtcatgtccagtaacacagaagcaaccaactacagtatagcctgataacatgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtactaatttcaa

SEQ ID NO: 151094 - DNA, 1206 bp, Homo sapiens
  Payload ID: 9772
  Gene Symbol: HLA-DQA1
  Gene Name: major histocompatibility complex, class II, DQ alpha 1
  Uniprot ID: P01909
  ENST ID: ENST00000395363
  CDS Start-End: 59-826
tcctcacaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtgaatcccatcctggaagggaagggctgactgaaactatggctaataattggggtactcttatgtttcaatccaatttaacctcatttcccagatcatttttcatgtccagtaacacagaagccaccaagtacagtatagcctgataatatgttgatttcttagctgacattaatatttcttgcttccttgtgttcccacccttggcactgccacccacccctcaattcaggcaacaatgaaattaatggataccgtctgcccttggcccagaattgttatagcaaaaattttagaaccaaaaaataagtctgtactaatttcaatgtggcttttaaaagtatgacagagaaataagttaggataaaggaaatttgaatctca

SEQ ID NO: 151095 - DNA, 1103 bp, Homo sapiens
  Payload ID: 9772
  Gene Symbol: HLA-DQA1
  Gene Name: major histocompatibility complex, class II, DQ alpha 1
  Uniprot ID: P01909
  ENST ID: ENST00000399675
  CDS Start-End: 20-784
aggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtcttcatcatccgaggcctgcgttcagttggtgcttccagacaccaagggcccttgtgaatcccatcctggaatggaagggctgactgaaaccgtggctaagaattgggagactctcttgtttcaagccaatttaacatcatttaccagatcatttgtcatgtccagtaacacagaagcaaccaactacagtatagcctgataacatgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtactaatttcaa

SEQ ID NO: 151096 - DNA, 1237 bp, Homo sapiens
  Payload ID: 9772
  Gene Symbol: HLA-DQA1
  Gene Name: major histocompatibility complex, class II, DQ alpha 1
  Uniprot ID: P01909
  ENST ID: ENST00000399678
  CDS Start-End: 20-784
aggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtcttcatcatccgaggcctgcgttcagttggtgcttccagacaccaagggcccttgtgaatcccatcctggaatggaagtgttacctactaagagttgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttaacatcatttaccagatcatttgtcatgtccagtaacacagaagcaaccaactacagtatagcctgataacatgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtactaatttcaa

SEQ ID NO: 151097 - DNA, 1217 bp, Homo sapiens
  Payload ID: 9772
  Gene Symbol: HLA-DQA1
  Gene Name: major histocompatibility complex, class II, DQ alpha 1
  Uniprot ID: P01909
  ENST ID: ENST00000418023
  CDS Start-End: 103-870
ggcagggtttggtttgggtgtcttcagatttccttgtcttgaggccctcacaattgctctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgcatcaccatctacagcagcggaagagtggacttgctacatgacctagcactattctctggcccgatttatcataccctttttctcctgcaaatgtttctcctcttaccttttctctgctttttttttcttaagcttctgtatcccctcagagctcacaaatgcctttgaattctttccctgacctcctgatttttttttcttttctcaggtgttacctactaagagatgcctggggtaagccgcccagctacctaattcctcagtaacatcgatctaaaatctccatggaagcaataaattccctttaagagatctatgtcaaa

SEQ ID NO: 151098 - DNA, 1385 bp, Homo sapiens
  Payload ID: 9772
  Gene Symbol: HLA-DQA1
  Gene Name: major histocompatibility complex, class II, DQ alpha 1
  ENST ID: ENST00000456258
  CDS Start-End: 103-870
ggcagggtttggtttgggtgtcttcagatttccttgtcttgaggccctcacaattgctctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgatgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcaca

SEQ ID NO: 151099 - DNA, 520 bp, Homo sapiens
  Payload ID: 9772
  Gene Symbol: HLA-DQA1
  Gene Name: major histocompatibility complex, class II, DQ alpha 1
  ENST ID: ENST00000414549
  CDS Start-End: 448-520
aagagcaaaataatatgaaaagtatttaacaaggaatataaagaatcatcaaagaaaatgttataaaacttctttgagaccacaagagatgatagagatggggtttcactgtgttagcgaggatggtcttgatctcctgacctcgtgatccgcctgcttctgcctcccaaagtgctgggattacagtcgtgagccaccgcgcctggcctcctcatattattttttattgtgcagtttattcaagagagctttccagcacctgtgataagcctcagcccgcctgctggataatgagcccacatggattgagagaggcctcctatccctgccaaacctattgatgctacagagatgtgagggagcccacctgagaaaagctgaacctgcccagtacataaaaaccactcagctcagaacagcaactgctgaggctgccttgggaagaagatgatcctaaacaaagctctgatgctgggggccctcgccctgaccaccgtgatgagcccttgtggaggtgaag

SEQ ID NO: 151100 - DNA, 1206 bp, Homo sapiens
  Payload ID: 9772
  Gene Symbol: HLA-DQA1
  Gene Name: major histocompatibility complex, class II, DQ alpha 1
  ENST ID: ENST00000450614
  CDS Start-End: 59-826
ccctcacaattgctctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgatgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaagggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcaca

SEQ ID NO: 151101 - DNA, 1594 bp, Homo sapiens
  Payload ID: 9772
  Gene Symbol: HLA-DQA1
  Gene Name: major histocompatibility complex, class II, DQ alpha 1
  ENST ID: ENST00000443320
  CDS Start-End: 103-867
ggcagggtttggtttgggtgtcttcagatttccttgtcttgaggtcctcacaattactctacagctcagaacagcaactgctgaggctgccttgggaagaagatgatcctaaacaaagctctgatgctgggggccctcgccctgaccaccgtgatgagcccttgtggaggtgaagacattgtggctgaccacgttgcctcttacggtgtaaacttgtaccagtcttacggtccctctggccagttcacccatgaatttgatggagacgaggagttctatgtggacctggagaggaaggagactgtctggaagttgcctctgttccacagacttagatttgacccgcaatttgcactgacaaacatcgctgtgctaaaacataacttgaacatcctgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccagcacctatgtcagagctcacagagactgtggtctgtgccctggggttgtctgtgggcctcgtgggcattgtggtggggaccgtcttgatcatccgaggcctgcgttcagttggtgcttccagacaccaagggcccttgtgaatcccatcctgaaaaagaaggtgcatcaccatctacagcagcggaagagtggacttgctacatgacctagcactattctctggcccgatttatcataccctttttctcctgcaaatgtttctcctcttaccttttctctgcttttttttccttaagcttctgtatcccctcagagctcacaaatgcctttgaattctttccctgacctcctgatttttttttcttttctcaggtgttacctactaagagatgcctggggtaagccgcccagctacctaattcctcagtaacatcgatctaaaatctccatggaagcaataaattccctttaagagatctatgtcaaatttttccatctttcatccggggctgactgaacctatggctaagaattgggacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcaca

SEQ ID NO: 151102 - DNA, 1049 bp, Homo sapiens
  Payload ID: 9772
  Gene Symbol: HLA-DQA1
  Gene Name: major histocompatibility complex, class II, DQ alpha 1
  ENST ID: ENST00000442680
  CDS Start-End: 40-804
gctcagaacagcaactgctgaggctgccttgggaagaagatgatcctaaacaaagctctgatgctgggggccctcgccctgaccaccgtgatgagcccttgtggaggtgaagacattgtggctgaccacgttgcctcttacggtgtaaacttgtaccagtcttacggtccctctggccagttcacccatgaatttgatggagacgaggagttctatgtggacctggagaggaaggagactgtctggaagttgcctctgttccacagacttagatttgacccgcaatttgcactgacaaacatcgctgtgctaaaacataacttgaacatcctgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccagcacctatgtcagagctcacagagactgtggtctgtgccctggggttgtctgtgggcctcgtgggcattgtggtggggaccgtcttgatcatccgaggcctgcgttcagttggtgcttccagacaccaagggcccttgtgaatcccatcctgaaaaagaaggtaagtttgagatttgttagagctgaagctgcaggaaggaaagtgggaggaggctgtggacatgaatgtggttgaaagttgtaggggaattgggaagtggcatgatgatgacacaggagcccccttggacccatcgatctcatgtctgtcctgttgcaggtgcatcaccatctacagcagcggaagagtggacttgctacatgacctagcactattctctggccc

SEQ ID NO: 151103 - DNA, 1594 bp, Homo sapiens; identical to SEQ ID NO: 151101
  Payload ID: 9772
  Gene Symbol: HLA-DQA1
  Gene Name: major histocompatibility complex, class II, DQ alpha 1
  ENST ID: ENST00000453504
  CDS Start-End: 103-867

SEQ ID NO: 151104 - DNA, 1548 bp, Homo sapiens
  Payload ID: 9772
  Gene Symbol: HLA-DQA1
  Gene Name: major histocompatibility complex, class II, DQ alpha 1
  ENST ID: ENST00000441297
  CDS Start-End: 54-821
acaattgctctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgatgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgcatcaccatctacagcagcggaagagtggacttgctacatgacctagcactattctctggcccgatttatcataccctttttctcctgcaaatgtttctcctcttaccttttctctgctttttttttcttaagcttctgtatcccctcagagctcacaaatgcctttgaattctttccctgacctcctgatttttttttcttttctcaggtgttacctactaagagatgcctggggtaagccgcccagctacctaattcctcagtaacatcgatctaaaatctccatggaagcaataaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcaca

SEQ ID NO: 151105 - DNA, 1382 bp, Homo sapiens
  Payload ID: 9772
  Gene Symbol: HLA-DQA1
  Gene Name: major histocompatibility complex, class II, DQ alpha 1
  ENST ID: ENST00000457246
  CDS Start-End: 103-867
ggcagggtttggtttgggtgtcttcagatttccttgtcttgaggtcctcacaattactctacagctcagaacagcaactgctgaggctgccttgggaagaagatgatcctaaacaaagctctgatgctgggggccctcgccctgaccaccgtgatgagcccttgtggaggtgaagacattgtggctgaccacgttgcctcttacggtgtaaacttgtaccagtcttacggtccctctggccagttcacccatgaatttgatggagacgaggagttctatgtggacctggagaggaaggagactgtctggaagttgcctctgttccacagacttagatttgacccgcaatttgcactgacaaacatcgctgtgctaaaacataacttgaacatcctgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccagcacctatgtcagagctcacagagactgtggtctgtgccctggggttgtctgtgggcctcgtgggcattgtggtggggaccgtcttgatcatccgaggcctgcgttcagttggtgcttccagacaccaagggcccttgtgaatcccatcctgaaaaagaaggtgttacctactaagagatgcctggggtaagccgcccagctacctaattcctcagtaacatcgatctaaaatctccatggaagcaataaattccctttaagagatctatgtcaaatttttccatctttcatccggggctgactgaacctatggctaagaattgggacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcaca

SEQ ID NO: 151106 - DNA, 520 bp, Homo sapiens
  Payload ID: 9772
  Gene Symbol: HLA-DQA1
  Gene Name: major histocompatibility complex, class II, DQ alpha 1
  ENST ID: ENST00000422863
  CDS Start-End: 448-520
aagagcaaaataatatgaaaagtatttaacaaggaatataaagaatcatcaaagaaaatgttataaaacttctttgagaccacaagagatgatagagatggggtttcactgtgttagcgaggatggtcttgatctcctgacctcgtgatccgcctgcttctgcctcccaaagtgctgggattacagtcgtgagccaccgcgcctggcctcctcatattattttttattgtgcagtttattcaagagagctttccagcacctgtgataagcctcagcccgcctgccggataatgagcccacatggattgagagaggcctcctatccctgccaaacctattgatgctacagagatgtgagggagcccacctgagaaaagctgaacctgcccagtacataaaaaccactcagctcagaacaccaactgctgaggctgccttgggaagaggatgatcctaaacaaagctctgctgctgggggccctcgctctgaccaccgtgatgagcccctgtggaggtgaag

SEQ ID NO: 151107 - DNA, 1203 bp, Homo sapiens
  Payload ID: 9772
  Gene Symbol: HLA-DQA1
  Gene Name: major histocompatibility complex, class II, DQ alpha 1
  ENST ID: ENST00000416403
  CDS Start-End: 59-823
tcctcacaattactctacagctcagaacagcaactgctgaggctgccttgggaagaagatgatcctaaacaaagctctgatgctgggggccctcgccctgaccaccgtgatgagcccttgtggaggtgaagacattgtggctgaccacgttgcctcttacggtgtaaacttgtaccagtcttacggtccctctggccagttcacccatgaatttgatggagacgaggagttctatgtggacctggagaggaaggagactgtctggaagttgcctctgttccacagacttagatttgacccgcaatttgcactgacaaacatcgctgtgctaaaacataacttgaacatcctgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccagcacctatgtcagagctcacagagactgtggtctgtgccctggggttgtctgtgggcctcgtgggcattgtggtggggaccgtcttgatcatccgaggcctgcgttcagttggtgcttccagacaccaagggcccttgtgaatcccatcctgaaaaagaagggctgactgaacctatggctaagaattgggacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcaca

SEQ ID NO: 151108 - DNA, 1382 bp, Homo sapiens; identical to SEQ ID NO: 151105
  Payload ID: 9772
  Gene Symbol: HLA-DQA1
  Gene Name: major histocompatibility complex, class II, DQ alpha 1
  ENST ID: ENST00000451947
  CDS Start-End: 103-867

SEQ ID NO: 151109 - DNA, 922 bp, Homo sapiens
  Payload ID: 9772
  Gene Symbol: HLA-DQA1
  Gene Name: major histocompatibility complex, class II, DQ alpha 1
  Uniprot ID: P01909
  ENST ID: ENST00000444296
  CDS Start-End: 20-787
aggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagagatctatgtcaaa

SEQ ID NO: 151110 - DNA, 520 bp, Homo sapiens
  Payload ID: 9772
  Gene Symbol: HLA-DQA1
  Gene Name: major histocompatibility complex, class II, DQ alpha 1
  ENST ID: ENST00000445944
  CDS Start-End: 448-520
aagagcaaaataatatgaaaagtatttaacaaggaatataaagaatcatcaaagaaaatgttataaaacttctttgagaccacaagagatgatagagatggggtttcactgtgttagcgaggatggtcttgatctcctgacctcgtgatccgcctgcttctgcctcccaaagtgctgggattacagtcgtgagccaccgcgcctggcctcctcatattattttttattgtgcagtttattcaagagagctttccagcacctgtgataagcctcagcccgcctgccggataatgagcccacatggattgagagaggcctcctatccctgccaaacctattgatgctacagagatgtgagggagcccacctgagaaaagctgaacctgcccagtacataaaaaccactcagctcagaacagcaactgctgaggctgccttgggaagaggatgatcctaaacaaagctctgatgctgggggccctcgccctgaccaccgtgatgagcccttgtggaggtgaag

SEQ ID NO: 151111 - DNA, 520 bp, Homo sapiens; identical to SEQ ID NO: 151099
  Payload ID: 9772
  Gene Symbol: HLA-DQA1
  Gene Name: major histocompatibility complex, class II, DQ alpha 1
  ENST ID: ENST00000448163
  CDS Start-End: 448-520

SEQ ID NO: 151112 - DNA, 1001 bp, Homo sapiens
  Payload ID: 9772
  Gene Symbol: HLA-DQA1
  Gene Name: major histocompatibility complex, class II, DQ alpha 1
  ENST ID: ENST00000420385
  CDS Start-End: 34-801
aacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgatgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtaagattgagatttgttagagctgaagctgcaggaaggaaagtgggaggaggctgtggacatgaatgtggttgaaagttgtaggggaattgggaagtggcatgatgatgacacaggagcccccttggacccatcgatctcatgtctgtcctgttgcaggtgcatcaccatctacagcag

SEQ ID NO: 151113 - DNA, 1049 bp, Homo sapiens; identical to SEQ ID NO: 151102
  Payload ID: 9772
  Gene Symbol: HLA-DQA1
  Gene Name: major histocompatibility complex, class II, DQ alpha 1
  ENST ID: ENST00000450960
  CDS Start-End: 40-804

SEQ ID NO: 151114 - DNA, 1203 bp, Homo sapiens; identical to SEQ ID NO: 151107
  Payload ID: 9772
  Gene Symbol: HLA-DQA1
  Gene Name: major histocompatibility complex, class II, DQ alpha 1
  ENST ID: ENST00000442315
  CDS Start-End: 59-823

SEQ ID NO: 151115 - DNA, 2100 bp, Homo sapiens
  Payload ID: 9772
  Gene Symbol: HLA-DQA1
  Gene Name: major histocompatibility complex, class II, DQ alpha 1
  ENST ID: ENST00000468299
  CDS Start-End: 33-380
acagcaactgctgaggctgccttgggaagaagatgatcctaaacaaagctctgatgctgggggccctcgccctgaccaccgtgatgagcccttgtggaggtgaagacattgtgggatccatctctgactccctgctcctttatagagatggacatgagtttgtaaaacaaaagttgaaaagtcagatagttaaaaggggaagtaaactggaaggtactctaaactttcacaaccttattaaccgtggcagctcccattctgattttgttcagcagtggaagtttcaccctctcctccagagcgcttggcttctttgttccaaatttcctttcttcagcctcacaccagagtgccctggtcaggctcagctcatccattaggcacaatgtgggcagtgcaggggaacctccatactgtaaagccacatgagaatgttttaactccttttaaaattataaaaaaatgaaattgtagagcctaagaaaatgttttaacttttaattcagcctatattatattgtctttataccaattcagtcataaaatataattttccatatttttatggaggaaggcgtccacacaagcaagagtgcttggggctcacatgtcagaacgcatccctgatcatggctgatcctgaccttcgtgtggttctgctaactatgtgcctgtcagtcttccccaaaatctatgtggtcctcaaatataacaactgtcattcaatacacatgtttgagcacccagtgagctaagttttaaggattcaaagatgaaaagtcatgctgtctcccctgcagagggtgctcagactagtgatggaaacagtatgggatgaaagaaagcagaaggccattgctgagcaggcagtggactcagcagaggctgaaactatacaagtgacttggttccagctgggccagcaggataaccagacgaaaagaaggattgcatatattccatatatatttatgtttgaacaaagagtcaaggtttattgcaaggataaggaggctttgttggtggcctgttaagaccatccagcgtggtcatactggatagggaagaagctgaccacgttgcctcttacggtgtaaacttgtaccagtcttacggtccctctggccagttcacccatgaatttgatggagacgaggagttctatgtggacctggagaggaaggagactgtctggaagttgcctctgttccacagacttagatttgacccgcaatttgcactgacaaacatcgctgtgctaaaacataacttgaacatcctgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccagcacctatgtcagagctcacagagactgtggtctgtgccctggggttgtctgtgggcctcgtgggcattgtggtggggaccgtcttgatcatccgaggcctgcgttcagttggtgcttccagacaccaagggcccttgtgaatcccatcctgaaaaagaaggtgcatcaccatctacagcagcggaagagtggacttgctacatgacctagcactattctctggcccgatttatcataccctttttctcctgcaaatgtttctcctcttaccttttctctgcttttttttccttaagcttctgtatcccctcagagctcacaaatgcctttgaattctttccctgacctcctgatttttttttcttttctcaggtgttacctactaagagatgcctggggtaagccgcccagctacctaattcctcagtaacatcgatctaaaatctccatggaagcaataaattccctttaagagatctatgtcaaa

SEQ ID NO: 151116 - DNA, 2100 bp, Homo sapiens; identical to SEQ ID NO: 151115
  Payload ID: 9772
  Gene Symbol: HLA-DQA1
  Gene Name: major histocompatibility complex, class II, DQ alpha 1
  ENST ID: ENST00000461508
  CDS Start-End: 33-380

SEQ ID NO: 151117 - DNA, 2135 bp, Homo sapiens
  Payload ID: 9772
  Gene Symbol: HLA-DQA1
  Gene Name: major histocompatibility complex, class II, DQ alpha 1
  ENST ID: ENST00000482745
  CDS Start-End: 33-194
acaccaactgctgaggctgccttgggaagaggatgatcctaaacaaagctctgctgctgggggccctcgctctgaccaccgtgatgagcccctgtggaggtgaagacattgtgggatccatctctgactccctgctcctttatagagatggacagtgggtttgtaaaacaaaagttgaaaagtcagatagttaaaaggggaagtgaactggaaggtactttaaactttcacaactttattaaccgtggctgctcccattatgattttgttcggcagtggaagtttcacctgcttctccagagcgcttggcgtctttgttccaaatttcctttcttcaacctcacaccagagtgccctggtcaggcttggctcattcattaggcacaatgtgggcagtgcaggggaccctccatactgtaaagccacatgagaaggttttaactccttttaaaattagaaaaataatggaatattagagcctaagaaaatgttttaacttttaattcagcctagattatattgtctttataccaattcagtcataaaatataattttccatatttttgtggaggaagaggcccatacaagcaagaatgctcggggctcacatgtcagaatgcagccttggtcatgactgatcctggccttcgtatggttctgctacctgtgtgcctgcccgtcttccccaaaatctatgtggtcctcgaatatagcaactgtcattcaatacacatgtttgagcacacagtgagctaagttttaaggattcaaagatgaaaagtcatgctgtcttccctgcagagggtgctcagattagtgatggaaacagtatggggtgcaggaaagcagaaggccattgctgagcagggcagtggacccagcagaggctgaaacaatacaagtgacttggttccaggtgggccagcagggtgacgtcctctagcaaaatttggcacccaagacaagtaccagaagaaaagaaagactgcatgtattccacatatattcatgtttgaacaaggagtcaagatttatggcaaggataaggaggctttgttggtgacctgttaagaccaaccagggcagtcatgctggatagggaagaagctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtgaatcccatcctggaagggaaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaaagacatgcctggggtaagccacccggctacctaattcctcagtaacctccatctaaaatctccaaggaagcaataaattccttttatgagatctatgtcaaa

SEQ ID NO: 151118 - DNA, 2104 bp, Homo sapiens
  Payload ID: 9772
  Gene Symbol: HLA-DQA1
  Gene Name: major histocompatibility complex, class II, DQ alpha 1
  ENST ID: ENST00000484643
  CDS Start-End: 33-158
acagcaactgctgaggctgccttgggaagaggatgatcctaaacaaagctctgatgctgggggccctcgccctgaccaccgtgatgagcccttgtggaggtgaagacattgtgggatccatctctgactccctgctcctttatagagatggacagtgagtttgtaaaacaaaagttgaaaagtcagatagttaaaaggggaagtgaactggaaggtactctaaactttcacaaccttattaaccatggctgctcccattctgattttgttcagcagtggaagtttcacccgctcctccagagcgcttggcttctttgttccaaatttcctttcttcaacctcacaccagagtgccctggtcaggctcagctcatccattaggcacaatgtgggcagtgcaggggaccctccagactgtaaagccacatgagaatgttttaactccttttaaaattataaaaaaatgaaattgtagagcctaagaaaatgttttaacttttaattcagcctagattatattgtctttataccaattcagtcataaaatatagttttccatatttttatggaggaaggcgtccacacaagcaagagtgcttggggctcacatgtcagaacgcaaccctgatcatggctgatcctggccttcgtgtggttctgctaactatgtgcctgtcagtcttccccaaaatctatgtggtcctcaaatataacaactgtcattcaatacacatgtttgagcacccagtgagctaagttttaaggattcaaagatgaaaagtcatgctgtctcctctgcaaagggtgctcagactagtgatggaaacagtatgggatgaaagaaagcagaaggccattgctgagcaggcagtggactcagcagaggctgaaactatacaagtgacttggttccagctgggccagcaggataaccagatgaaaagaaggattgcatatattccatatatatttatgtttgaacaaagagtcaaggtttattgcaaggataaggaggttttgttggtggcctgttaagaccatccagggtggtcatactggatagggaagaagctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgatgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgcatcaccatctacagcagcggaagagtggacttgctacatgacctagcactattctctggcccgatttatcataccctttttctcctgcaaatgtttctcctcttaccttttctctgctttttttttcttaagcttctgtatcccctcagagctcacaaatgcctttgaattctttccctgacctcctgatttttttttcttttctcaggtgttacctactaagagatgcctggggtaagccgcccagctacctaattcctcagtaacatcgatctaaaatctccatggaagcaataaattccctttaagagatctatgtcaaa

SEQ ID NO: 151119 - DNA, 696 bp, Homo sapiens
  Payload ID: 9772
  Gene Symbol: HLA-DQA1
  Gene Name: major histocompatibility complex, class II, DQ alpha 1
  ENST ID: ENST00000496318
  CDS Start-End: 54-696
acaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactggggtgcatcgccatctacaggagcagaagaat

SEQ ID NO: 151120 - DNA, 1079 bp, Homo sapiens
  Payload ID: 9772
  Gene Symbol: HLA-DQA1
  Gene Name: major histocompatibility complex, class II, DQ alpha 1
  Uniprot ID: P01909
  ENST ID: ENST00000548014
  CDS Start-End: 51-815
attgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtcttcatcatccgaggcctgcgttcagttggtgcttccagacaccaagggcccttgtgaatcccatcctggaatggaaggtgttacctactaagagttgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttcatatcattccccagatcatatttcatgtccagtaacacaggagcaaccaagta

SEQ ID NO: 151121 - DNA, 768 bp, Homo sapiens
  Payload ID: 9772
  Gene Symbol: HLA-DQA1
  Gene Name: major histocompatibility complex, class II, DQ alpha 1
  ENST ID: ENST00000547425
  CDS Start-End: 1-768
atgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatga

SEQ ID NO: 151122 - DNA, 768 bp, Homo sapiens
  Payload ID: 9772
  Gene Symbol: HLA-DQA1
  Gene Name: major histocompatibility complex, class II, DQ alpha 1
  ENST ID: ENST00000614772
  CDS Start-End: 1-768
atgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttgatgcttccagacaccaagggctcttatga

SEQ ID NO: 151123 - DNA, 1517 bp, Homo sapiens
  Payload ID: 9773
  Gene Symbol: HLA-DQA2
  Gene Name: major histocompatibility complex, class II, DQ alpha 2
  Uniprot ID: P01906
  ENST ID: ENST00000241802
  CDS Start-End: 103-870
ggcagggtttggtttgggtgtcttcagatttgcttgtctcgaggtcctcacaattgctctacagctcagagcagcaactgctgaggctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctacgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttgatgcttccagacaccaagggctcttatgaatctcatcctgaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgagtaagccactcagctacctaattcctcaatgacctttatctaaaatctccatggaagcaataaattcccttttgatgcctctattgaatttttcccatctttcatctcagggctgactgagagcataacttagaatgggtgactcttatgttttaggccaatttcatgtcattccccagatcatatttcatgtccagtaacacaggagcaaccaagtacagtgtatcctgataatttgttgatttcttaactggtgttaatatttctttcttccttttgttcctacccttggccactgccacccacccctcaattcaggtaccaacgaaccctctgcccttggctcagaatggttatagcagaaatacaaaaaaaaaaaaaaaaagtctgtact

SEQ ID NO: 151124 - DNA, 1524 bp, Homo sapiens
  Payload ID: 9773
  Gene Symbol: HLA-DQA2
  Gene Name: major histocompatibility complex, class II, DQ alpha 2
  Uniprot ID: P01906
  ENST ID: ENST00000374940
  CDS Start-End: 103-870
ggcagggtttggtttgggtgtcttcagatttgcttgtctcgaggtcctcacaattgctctacagctcagagcagcaactgctgaggctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctatgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatgaatcccatcctgaaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgggtaagccactcagctacctaattcctcaatgacctttatctaaaatctccatggaagcaataaattcccttttgatgcctctattgaatttttcccatctttcatctcagggctgactgagagcataacttagaatgggcgactcttatgttttaggccaatttcatatcattccccagatcatatttcaagtccagtaacacaggagcaaccaagtacagtgtatcctgataatttgttgatttcttaactggtgttaatatttctttcttccttttgttcctacccttggccactgccagccacccctcaattcaggtaccaacgaaccctctgcccttggctcagaatggttatagcagaaatacaaaaaaaaaaaaaaagtctgtactaatttcaa

SEQ ID NO: 151125 - DNA, 1201 bp, Homo sapiens
  Payload ID: 9773
  Gene Symbol: HLA-DQA2
  Gene Name: major histocompatibility complex, class II, DQ alpha 2
  Uniprot ID: P01906
  ENST ID: ENST00000453672
  CDS Start-End: 103-870
ggcagggtttggtttgggtgtcttcagatttgcttgtctcgaggtcctcacaattgctctgcagctcagagcagcaactgctgaggctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagatgaggagttctacgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgcgggcctcatgggcattgtggtgggcactgtcttcatcatccaaggcctgcgttcagttggtgcttccagacaccaagggctcttgtgaatcccatcctgaaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatacctttcaattctttccctgacctcctttcctgaatttttttattttctcaaatgttacctactaagggatgcctgggtaagccacttagctacctaattcctcaatgacctttatctaaaatctccatggaagcaataaattcccttttatga

SEQ ID NO: 151126 - DNA, 1499 bp, Homo sapiens
  Payload ID: 9773
  Gene Symbol: HLA-DQA2
  Gene Name: major histocompatibility complex, class II, DQ alpha 2
  Uniprot ID: P01906
  ENST ID: ENST00000446482
  CDS Start-End: 103-870
ggcagggtttggtttgggtgtcttcagatttgcttgtctcgaggtcctcacaattgctctgcagctcagagcagcaactgctgaggctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagatgaggagttctacgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgcgggcctcatgggcattgtggtgggcactgtcttcatcatccaaggcctgcgttcagttggtgcttccagacaccaagggctcttgtgaatcccatcctgaaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatacctttcaattctttccctgacctcctttcctgaatttttttattttctcaaatgttacctactaagggatgcctgggtaagccacttagctacctaattcctcaatgacctttatctaaaatctccatggaagcaataaattcccttttatgatgcctctattgaatttttcccatctttcatctcagggctgactgagagcataacttagaatgggcgactcttatgttttaggccaatttcatatcattccccagatcatatttcatgtccagtaacacaggagcaaccaagtacagtgtatcctgataatttgttgatttcttaactggtgttaatatttctttcttccttttgttcctacccttggccactgccacccacccttcaattcaggtaccaacgaaccctctgcccttggctcagaatggttatagcagaaatccaaaaa

SEQ ID NO: 151127 - DNA, 1500 bp, Homo sapiens
  Payload ID: 9773
  Gene Symbol: HLA-DQA2
  Gene Name: major histocompatibility complex, class II, DQ alpha 2
  Uniprot ID: P01906
  ENST ID: ENST00000447735
  CDS Start-End: 87-854
ggtgtcttcagatttgcttgtctcgaggtcctcacaattgctctacagctcagagcagcaactgctgaggctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctacgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatgaatctcatcctgaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgagtaagccactcagctacctaattcctcaatgacctttatctaaaatctccatggaagcaataaattcccttttgatgcctctattgaatttttcccatctttcatctcagggctgactgagagcataacttagaatgggtgactcttatgttttaggccaatttcatgtcattccccagatcatatttcatgtccagtaacacaggagcaaccaagtacagtgtatcctgataatttgttgatttcttaactggtgttaatatttctttcttccttttgttcctacccttggccactgccacccacccctcaattcaggtaccaacgaaccctctgcccttggctcagaatggttatagcagaaatacaaaaaaaaaaaaaaaagtctgtact

SEQ ID NO: 151128 - DNA, 1521 bp, Homo sapiens
  Payload ID: 9773
  Gene Symbol: HLA-DQA2
  Gene Name: major histocompatibility complex, class II, DQ alpha 2
  Uniprot ID: P01906
  ENST ID: ENST00000415898
  CDS Start-End: 103-870
ggcagggtttggtttgggtgtcttcagatttgcttgtctcgaggtcctcacaattgctctacagctcagagcagcaactgctgaggctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctatgtggacctggagacgaaagagactgtctggcagttgcctatgtttagcaaatttataagttttgacccgcagagtgcactgagaaatatggctgtgggaaaacacaccttggaattcatgatgggacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatgaatcccatcctgaaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgggtaagccactcagctacctaattcctcaatgacctttatctaaaatctccatggaagcaataaattcccttttgatgcctctattgaatttttcccatctttcatctcagggctgactgagagcataacttagaatgggcgactcttatgttttaggccaatttcatatcattccccagatcatatttcaagtccagtaacacaggagcaaccaagtacagtgtatcctgataatttgttgatttcttaactggtgttaatatttctttcttccttttgttcctacccttggccactgccagccacccctcaattcaggtaccaacgaaccctctgcccttggctcagaatggttatagcagaaatacaaaaaaaaaaaaaaaagtctgtactaatt

SEQ ID NO: 151129 - DNA, 1648 bp, Homo sapiens
  Payload ID: 9773
  Gene Symbol: HLA-DQA2
  Gene Name: major histocompatibility complex, class II, DQ alpha 2
  Uniprot ID: P01906
  ENST ID: ENST00000449560
  CDS Start-End: 63-830
gaggtcctcacaattgctctacagctcagagcagcaactgctgagcctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctatgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatgaatcccatcctgaaaaggaaggtaagattgagatttgttggagctgaaacctcagtatgagagggaggaaagtgggagggggttgtggacatgaatgtggttgaaagttgtaggcgaattgggaagtggcatgatgatcacacaggaggcccctcagacccatcgatctcatgtctgtcctgttgcaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgggtaagccactcagctacctaattcctcaatgacctttatctaaaatctccatggaagcaataaattcccttttgatgcctctattgaatttttcccatctttcatctcagggctgactgagagcataacttagaatgggcgactcttatgttttaggccaatttcatatcattccccagatcatatttcaagtccagtaacacaggagcaaccaagtacagtgtatcctgataatttgttgatttcttaactggtgttaatatttctttcttccttttgttcctacccttggccactgccagccacccctcaattcaggtaccaacgaaccctctgcccttggctcagaatggttatagcagaaatacaaaaaaaaaaaaaaaagtctgtactaatt

SEQ ID NO: 151130 - DNA, 1725 bp, Homo sapiens
  Payload ID: 9773
  Gene Symbol: HLA-DQA2
  Gene Name: major histocompatibility complex, class II, DQ alpha 2
  Uniprot ID: P01906
  ENST ID: ENST00000443184
  CDS Start-End: 103-870
ggcagggtttggtttgggtgtcttcagatttgcttgtctcgaggtcctcacaattgctctacagctcagagcagcaactgctgagcctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctatgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatgaatcccatcctgaaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgggtaagccactcagctacctaattcctcaatgacctttatctaaaatctccatggaagcaataaattcccttttgatgcctctattgaatttttcccatctttcatctcagggctgactgagagcataacttagaatgggcgactcttatgttttaggccaatttcatatcattccccagatcatatttcaagtccagtaacacaggagcaaccaagtacagtgtatcctgataatttgttgatttcttaactggtgttaatatttctttcttccttttgttcctacccttggccactgccagccacccctcaattcaggtaccaacgaaccctctgcccttggctcagaatggttatagcagaaatacaaaaaaaaaaaaaaaagtctgtactaatttcaatatggctcttaaaaggaatgacagagaaataggatacaagaattttgaatctcaaaagttatcaaaagtaaaaaattttgttaccaaaagtcaaactgcattctcaaaactttaaatttgtgaagaatgacaacagtagaagctttcctctccccttctcaccttgaggagataaaaattctctaggcaggaaaagaaat

SEQ ID NO: 151131 - DNA, 768 bp, Homo sapiens
  Payload ID: 9773
  Gene Symbol: HLA-DQA2
  Gene Name: major histocompatibility complex, class II, DQ alpha 2
  ENST ID: ENST00000547960
  CDS Start-End: 1-768
atgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctacgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttgatgcttccagacaccaagggctcttatga

SEQ ID NO: 151132 - DNA, 1422 bp, Homo sapiens
  Payload ID: 9773
  Gene Symbol: HLA-DQA2
  Gene Name: major histocompatibility complex, class II, DQ alpha 2
  ENST ID: ENST00000552745
  CDS Start-End: 35-799
gaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtcttcatcatccgaggcctgcgttcagttggtgcttccagacaccaagggcccttgtgaatcccatcctggaatggaaggtgcatcgccatctacaggagcagaagagtggacttgctacatgacctagcattattttctggccccatttatcatatcccttttctcctccaaatgtttctcctctcacctcttctgtgggacttaaattgctatatctgctcagagctcacaaatgcctttgaattatttccctgacttcctgatttttttcttcttaagtgttacctactaagagttgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttaacatcatttaccagatcatttgtcatgtccagtaacacagaagcaaccaactacagtatagcctgataacatgatttcttagctgacattaatatttctttcttccttgtgttcccacccttggcattgccacccacccctcaattaaggcaacaatgaagttaatggataccctctgcctttggctcagaaatgttatagcaaaaatttt

SEQ ID NO: 151133 - DNA, 1152 bp, Homo sapiens
  Payload ID: 9773
  Gene Symbol: HLA-DQA2
  Gene Name: major histocompatibility complex, class II, DQ alpha 2
  Uniprot ID: P01906
  ENST ID: ENST00000546801
  CDS Start-End: 59-826
tcctcacaattgctctacagctcagagcagcaactgctgagcctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctatgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatgaatcccatcctgaaaaggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgggtaagccactcagctacctaattcctcaatgacctttatctaaaatctccatggaagcaataaattcccttt

SEQ ID NO: 151134 - DNA, 768 bp, Homo sapiens
  Payload ID: 9773
  Gene Symbol: HLA-DQA2
  Gene Name: major histocompatibility complex, class II, DQ alpha 2
  Uniprot ID: P01906
  ENST ID: ENST00000551533
  CDS Start-End: 1-768
atgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctacgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatga

SEQ ID NO: 151135 - DNA, 1079 bp, Homo sapiens
  Payload ID: 9773
  Gene Symbol: HLA-DQA2
  Gene Name: major histocompatibility complex, class II, DQ alpha 2
  ENST ID: ENST00000548145
  CDS Start-End: 51-815
attgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtcttcatcatccgaggcctgcgttcagttggtgcttccagacaccaagggcccttgtgaatcccatcctggaatggaaggtgttacctactaagagttgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttcatatcattccccagatcatatttcaagtccagtaacacaggagcaaccaagta

SEQ ID NO: 151136 - DNA, 1656 bp, Homo sapiens
  Payload ID: 9774
  Gene Symbol: HLA-DQB1
  Gene Name: major histocompatibility complex, class II, DQ beta 1
  ENST ID: ENST00000374943
  CDS Start-End: 78-887
attctttctgccaggtacatcagatccatcaggtccgagctgtgttgactaccactgcttttcccttcgtctcagttatgtcttggaagaaggctttgcggatccccggagaccttcgggtagcaactgtcaccttgatgctggcgatgctgagctccctactggctgagggcagagactctcccgaggatttcgtgttccagtttaagggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaaggacctcaagggcctccaccagcagggcttctgcactgactcctgagactattttaactaggattggttatcactcttctgtgatgcctgcttatgcctgcccagaattcccagctgcctgtgtcagcttgtccccctgagatcaaagtcctacagtggctgtcacgcagccaccaggtcatctcctttcatccccaccccaaggcgctggctgtgactctgcttcctgcactgacccagagcctctgcctgtgcatggccagctgcgtctactcaggtcccaaggggtttctgtttctattctttcctcagactgctcaagagaagcacatgaaaaacattacctgactttagagcttttttacataattaaacatgatcctgagttatctgtattctgaactttcttaattgagaagaggcaggaaatcactgcagaatgaaggaacatcccttgaggtgacccagcaaacctgtggccagaaggaggattgtaccttgaaaagacactgaaagcattttggggtgtgaagtaagggtgggcagaggaggtagaaaataattcaattgtcgcatcattcatggttctttaatactgatgctcagtgcattggccttagaatatcccagcctctcttctggtttggtgagtgctgtgtaaataagcatggtagaattgtttggagacatatatagtgatccttggtcactggtgtttcaaacattctggaaagtcacatcgatcaagaatattttttatttttaagaaagcataaccagcaataaaaatactatttttgagtctaaa

SEQ ID NO: 151137 - DNA, 1649 bp, Homo sapiens
  Payload ID: 9774
  Gene Symbol: HLA-DQB1
  Gene Name: major histocompatibility complex, class II, DQ beta 1
  ENST ID: ENST00000383121
  CDS Start-End: 57-842
atcagatccatcaggtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatgaccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcctctgcctgtgcacggccagctgcatctactcaggccccaaggggtttctgtttctattctctcctcagactgctcaagagaagcacatgaaaaccattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgttgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaatgatagaaacccaaatatattttgttcatggtgcaaa

SEQ ID NO: 151138 - DNA, 1649 bp, Homo sapiens; identical to SEQ ID NO: 151137
  Payload ID: 9774
  Gene Symbol: HLA-DQB1
  Gene Name: major histocompatibility complex, class II, DQ beta 1
  ENST ID: ENST00000383247
  CDS Start-End: 57-842

SEQ ID NO: 151139 - DNA, 1788 bp, Homo sapiens
  Payload ID: 9774
  Gene Symbol: HLA-DQB1
  Gene Name: major histocompatibility complex, class II, DQ beta 1
  ENST ID: ENST00000399065
  CDS Start-End: 210-1019
gcactggattgagaaccttcacaaaaaaaaatctgcccagagacagatgaggtccttcagctccagtgctgattggttcctttccaagggaccatccaatcctaccacgcatggaaacatccacaggtttttattctttctgccaggtacatcagatccatcaggtccgagctgtgttgactaccactacttttcccttcgtctcaattatgtcttggaaaaaggctttgcggatccccggaggccttcgggcagcaactgttaccttgatgctggcgatgctgagcaccccagtggctgagggcagagactctcccgaggatttcgtgtaccagtttaaggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagcaccccagcctccagaaccccatcaccgtggagtggcgggctcagtctgaatctgcccagagcaagatgctgagtggcattggaggcttcgtgctggggctcatcttcctcgggctgggccttattatccatcacaggagtcagaaaggacctcaagggcctccaccagcagggctcctgcactgactcctgagactattttaactgggattggttatcacttttctgtaacgcctgcttgtccctgcccagaattcccaactgcctgtgtcagcctgtccccctgagatcagagtcctacagtggctgtcacgcagccaccaggtcatctcctttcatccccaccccaaggcgctggctgtgactctgcttcctgcactgacccagagcctctgcctgtgcatggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 151140 - DNA, 1789 bp, Homo sapiens
  Payload ID: 9774
  Gene Symbol: HLA-DQB1
  Gene Name: major histocompatibility complex, class II, DQ beta 1
  ENST ID: ENST00000399074
  CDS Start-End: 211-1020
actggattgagaaccttcacaaaaaaaaaatgtctgcctagagacagattaggtccttcagctccagtgctgattggttcctttccaaaggaccatccaatcctgccacgcagggaaacatccacaggtttttattctttctgccaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcgggctcagtctgaatctgcccagagcaagatgctgagtggcattggaggcttcgtgctggggctgatcttcctcgggctgggccttattatccatcacaggagtcagaaaggacctcaagggcctccaccagcagggctcctgcactgactcctgagactattttaactgggattggttatcacttttctgtaacgcctgcttgtccctgcccagaattcccagctgcctgtgtcagcctgtcccccgagatcagagtcctacagtggctgtcacgcagccaccaggtcatctcctttcatccccacctcaaggctgatggctgtgaccctgcttcctgcactgacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaattttgggtgcaaagtcagggtgggcagaggaggtagaagatcaactcagttgtcgcatcattcatggttctttcatattgatgttcaatgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtattatttttgagtctaaa

SEQ ID NO: 151141 - DNA, 1501 bp, Homo sapiens
  Payload ID: 9774
  Gene Symbol: HLA-DQB1
  Gene Name: major histocompatibility complex, class II, DQ beta 1
  ENST ID: ENST00000399079
  CDS Start-End: 58-732
cagatccatcaggtccgagctgtgttgactaccactgcttttcccttcgtctcagttatgtcttggaagaaggctttgcggatccccggagaccttcgggtagcaactgtcaccttgatgctggcgatgctgagctccctactggctgagggcagagactctcccgaggatttcgtgttccagtttaagggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtggcggcttctgcactgactcctgagactattttaactaggattggttatcactcttctgtgatgcctgcttatgcctgcccagaattcccagctgcctgtgtcagcttgtccccctgagatcaaagtcctacagtggctgtcacgcagccaccaggtcatctcctttcatccccaccccaaggcgctggctgtgactctgcttcctgcactgacccagagcctctgcctgtgcatggccagctgcgtctactcaggtcccaaggggtttctgtttctattctttcctcagactgctcaagagaagcacatgaaaaacattacctgactttagagcttttttacataattaaacatgatcctgagttatctgtattctgaactttcttaattgagaagaggcaggaaatcactgcagaatgaaggaacatcccttgaggtgacccagcaaacctgtggccagaaggaggattgtaccttgaaaagacactgaaagcattttggggtgtgaagtaagggtgggcagaggaggtagaaaataattcaattgtcgcatcattcatggttctttaatactgatgctcagtgcattggccttagaatatcccagcctctcttctggtttggtgagtgctgtgtaaataagcatggtagaattgtttggagacatatatagtgatccttggtcactggtgtttcaaacattctggaaagtcacatcgatcaagaatattttttatttttaagaaagcataaccagcaataaaaatactatttttgagtctaaa

SEQ ID NO: 151142 - DNA, 1219 bp, Homo sapiens
  Payload ID: 9774
  Gene Symbol: HLA-DQB1
  Gene Name: major histocompatibility complex, class II, DQ beta 1
  ENST ID: ENST00000399082
  CDS Start-End: 46-450
gtccgagctgtgttgactaccactgcttttcccttcgtctcagttatgtcttggaagaaggctttgcggatccccggagaccttcgggtagcaactgtcaccttgatgctggcgatgctgagctccctactggctgagggcagagactctcccgtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtggcggcttctgcactgactcctgagactattttaactaggattggttatcactcttctgtgatgcctgcttatgcctgcccagaattcccagctgcctgtgtcagcttgtccccctgagatcaaagtcctacagtggctgtcacgcagccaccaggtcatctcctttcatccccaccccaaggcgctggctgtgactctgcttcctgcactgacccagagcctctgcctgtgcatggccagctgcgtctactcaggtcccaaggggtttctgtttctattctttcctcagactgctcaagagaagcacatgaaaaacattacctgactttagagcttttttacataattaaacatgatcctgagttatctgtattctgaactttcttaattgagaagaggcaggaaatcactgcagaatgaaggaacatcccttgaggtgacccagcaaacctgtggccagaaggaggattgtaccttgaaaagacactgaaagcattttggggtgtgaagtaagggtgggcagaggaggtagaaaataattcaattgtcgcatcattcatggttctttaatactgatgctcagtgcattggccttagaatatcccagcctctcttctggtttggtgagtgctgtgtaaataagcatggtagaattgtttggagacatatatagtgatccttggtcactggtgtttcaaacattctggaaagtcacatcgatcaagaatattttttatttttaagaaagcataaccagcaataaaaatactatttttgagtctaaa

SEQ ID NO: 151143 - DNA, 1734 bp, Homo sapiens
  Payload ID: 9774
  Gene Symbol: HLA-DQB1
  Gene Name: major histocompatibility complex, class II, DQ beta 1
  ENST ID: ENST00000399084
  CDS Start-End: 180-965
aggatggattagagacctctattttgaggcgcactgatgtaggggctgaggaaggacattgagggcaccttcaggtctctctgcctattcttccttgccccaactccattccaggtgtacatcagatccatcaggtccgagctgtgttgactaccactgcttttcccttcgtctcagttatgtcttggaagaaggctttgcggatccccggagaccttcgggtagcaactgtcaccttgatgctggcgatgctgagctccctactggctgagggcagagactctcccgaggatttcgtgttccagtttaagggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaagggcttctgcactgactcctgagactattttaactaggattggttatcactcttctgtgatgcctgcttatgcctgcccagaattcccagctgcctgtgtcagcttgtccccctgagatcaaagtcctacagtggctgtcacgcagccaccaggtcatctcctttcatccccaccccaaggcgctggctgtgactctgcttcctgcactgacccagagcctctgcctgtgcatggccagctgcgtctactcaggtcccaaggggtttctgtttctattctttcctcagactgctcaagagaagcacatgaaaaacattacctgactttagagcttttttacataattaaacatgatcctgagttatctgtattctgaactttcttaattgagaagaggcaggaaatcactgcagaatgaaggaacatcccttgaggtgacccagcaaacctgtggccagaaggaggattgtaccttgaaaagacactgaaagcattttggggtgtgaagtaagggtgggcagaggaggtagaaaataattcaattgtcgcatcattcatggttctttaatactgatgctcagtgcattggccttagaatatcccagcctctcttctggtttggtgagtgctgtgtaaataagcatggtagaattgtttggagacatatatagtgatccttggtcactggtgtttcaaacattctggaaagtcacatcgatcaagaatattttttatttttaagaaagcataaccagcaataaaaatactatttttgagtctaaa

SEQ ID NO: 151144 - DNA, 1642 bp, Homo sapiens
  Payload ID: 9774
  Gene Symbol: HLA-DQB1
  Gene Name: major histocompatibility complex, class II, DQ beta 1
  Uniprot ID: P01920
  ENST ID: ENST00000399088
  CDS Start-End: 88-873
acaggtttttattctttctgccaggtacatcagatccatcaggtccgagctgtgttgactaccactacttttcccttcgtctcaattatgtcttggaaaaaggctttgcggatccccggaggccttcgggcagcaactgttaccttgatgctggcgatgctgagcaccccagtggctgagggcagagactctcccgaggatttcgtgtaccagtttaaggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagcaccccagcctccagaaccccatcaccgtggagtggcgggctcagtctgaatctgcccagagcaagatgctgagtggcattggaggcttcgtgctggggctcatcttcctcgggctgggccttattatccatcacaggagtcagaaagggctcctgcactgactcctgagactattttaactgggattggttatcacttttctgtaacgcctgcttgtccctgcccagaattcccaactgcctgtgtcagcctgtccccctgagatcagagtcctacagtggctgtcacgcagccaccaggtcatctcctttcatccccaccccaaggcgctggctgtgactctgcttcctgcactgacccagagcctctgcctgtgcatggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 151145 - DNA, 1473 bp, Homo sapiens
  Payload ID: 9774
  Gene Symbol: HLA-DQB1
  Gene Name: major histocompatibility complex, class II, DQ beta 1
  ENST ID: ENST00000399670
  CDS Start-End: 36-710
ctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatgaccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcctctgcctgtgcacggccagctgcatctactcaggccccaaggggtttctgtttctattctctcctcagactgctcaagagaagcacatgaaaaccattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgttgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttga

SEQ ID NO: 151146 - DNA, 1219 bp, Homo sapiens
  Payload ID: 9774
  Gene Symbol: HLA-DQB1
  Gene Name: major histocompatibility complex, class II, DQ beta 1
  ENST ID: ENST00000430790
  CDS Start-End: 46-450
gtccaagctgtgttgactaccactacttttcccttcgtctcaattatgtcttggaagaaggctttgcggatccctggaggccttcgggtagcaactgtgaccttgatgctggcgatgctgagcaccccggtggctgagggcagagactctcccgtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcggctcctgcactgactcctgagactattttaactgggattggttatcacttttctgtaacgcctgcttgtccctgcccagaattcccagctgcctgtgtcagcctgtcccccgagatcagagtcctacagtggctgtcacgcagccaccaggtcatctcctttcatccccacctcaaggctgatggctgtgaccctgcttcctgcactgacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaattttgggtgcaaagtcagggtgggcagaggaggtagaagatcaactcagttgtcgcatcattcatggttctttcatattgatgttcaatgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtattatttttgagtctaaa

SEQ ID NO: 151147 - DNA, 1643 bp, Homo sapiens
  Payload ID: 9774
  Gene Symbol: HLA-DQB1
  Gene Name: major histocompatibility complex, class II, DQ beta 1
  ENST ID: ENST00000414518
  CDS Start-End: 88-873
acaggtttttattctttctgccaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggaccgagcgcgtgcggggtgtgaccagatacatctataaccgagaggagtacgcgcgcttcgacagcgacgtgggggtgtatcgggcggtgacgccgctggggccgcctgccgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcgaggctgatggctgtgaccctgcttcctgcacttacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaagatcaactcagttgttgcatcattcatggttctttcatattgatgctcagtgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtactatttttgattctaaa

SEQ ID NO: 151148 - DNA, 1484 bp, Homo sapiens
  Payload ID: 9774
  Gene Symbol: HLA-DQB1
  Gene Name: major histocompatibility complex, class II, DQ beta 1
  ENST ID: ENST00000434886
  CDS Start-End: 41-715
agctgtgttgactaccactacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcggctcctgcactgactcctgagactattttaactgggattggttatcacttttctgtaacgcctgcttgtccctgcccagaattcccagctgcctgtgtcagcctgtcccccgagatcagagtcctacagtggctgtcacgcagccaccaggtcatctcctttcatccccacctcaaggctgatggctgtgaccctgcttcctgcactgacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaattttgggtgcaaagtcagggtgggcagaggaggtagaagatcaactcagttgtcgcatcattcatggttctttcatattgatgttcaatgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtattatttttgagtctaaa

SEQ ID NO: 151149 - DNA, 484 bp, Homo sapiens
  Payload ID: 9774
  Gene Symbol: HLA-DQB1
  Gene Name: major histocompatibility complex, class II, DQ beta 1
  ENST ID: ENST00000432856
  CDS Start-End: 51-484
atcaggtccaagctgtgttgactaccactacttttcccttcgtctcaattatgtcttggaagaaggctttgcggatccctggaggccttcgggtagcaactgtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagca

SEQ ID NO: 151150 - DNA, 1734 bp, Homo sapiens
  Payload ID: 9774
  Gene Symbol: HLA-DQB1
  Gene Name: major histocompatibility complex, class II, DQ beta 1
  Uniprot ID: P01920
  ENST ID: ENST00000413089
  CDS Start-End: 180-965
aggatggattagaggcctctattctgagggacactgaggtgggggctgaggaaggacattgagggcagcttcaggtctctctgcctactcttccttgccccaactccattccaggtgtacatcagatccatcaggtccgagctgtgttgactaccactacttttcccttcgtctcaattatgtcttggaaaaaggctttgcggatccccggaggccttcgggcagcaactgttaccttgatgctggcgatgctgagcaccccagtggctgagggcagagactctcccgaggatttcgtgtaccagtttaaggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagcaccccagcctccagaaccccatcaccgtggagtggcgggctcagtctgaatctgcccagagcaagatgctgagtggcattggaggcttcgtgctggggctcatcttcctcgggctgggccttattatccatcacaggagtcagaaagggctcctgcactgactcctgagactattttaactgggattggttatcacttttctgtaacgcctgcttgtccctgcccagaattcccaactgcctgtgtcagcctgtccccctgagatcagagtcctacagtggctgtcacgcagccaccaggtcatctcctttcatccccaccccaaggcgctggctgtgactctgcttcctgcactgacccagagcctctgcctgtgcatggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 151151 - DNA, 1640 bp, Homo sapiens
  Payload ID: 9774
  Gene Symbol: HLA-DQB1
  Gene Name: major histocompatibility complex, class II, DQ beta 1
  Uniprot ID: P01920
  ENST ID: ENST00000419914
  CDS Start-End: 85-870
acagatttttattctttctgccaggtacatcagatccatcaggtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 151152 - DNA, 481 bp, Homo sapiens
  Payload ID: 9774
  Gene Symbol: HLA-DQB1
  Gene Name: major histocompatibility complex, class II, DQ beta 1
  ENST ID: ENST00000456954
  CDS Start-End: 48-481
atcaggtccgagctgtgttgactaccacttttcccttcgtctcaattatgtcttggaaaaaggctttgcggatccccggaggccttcgggcagcaactgtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagca

SEQ ID NO: 151153 - DNA, 1217 bp, Homo sapiens
  Payload ID: 9774
  Gene Symbol: HLA-DQB1
  Gene Name: major histocompatibility complex, class II, DQ beta 1
  ENST ID: ENST00000428219
  CDS Start-End: 43-447
gtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 151154 - DNA, 1642 bp, Homo sapiens
  Payload ID: 9774
  Gene Symbol: HLA-DQB1
  Gene Name: major histocompatibility complex, class II, DQ beta 1
  ENST ID: ENST00000434651
  CDS Start-End: 88-873
acaggtttttattctttctgccaggtacatcagatccatcaggtccgagctgtgttgactaccactgcttttcccttcgtctcagttatgtcttggaagaaggctttgcggatccccggagaccttcgggtagcaactgtcaccttgatgctggcgatgctgagctccctactggctgagggcagagactctcccgaggatttcgtgttccagtttaagggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaagggcttctgcactgactcctgagactattttaactaggattggttatcactcttctgtgatgcctgcttatgcctgcccagaattcccagctgcctgtgtcagcttgtccccctgagatcaaagtcctacagtggctgtcacgcagccaccaggtcatctcctttcatccccaccccaaggcgctggctgtgactctgcttcctgcactgacccagagcctctgcctgtgcatggccagctgcgtctactcaggtcccaaggggtttctgtttctattctttcctcagactgctcaagagaagcacatgaaaaacattacctgactttagagcttttttacataattaaacatgatcctgagttatctgtattctgaactttcttaattgagaagaggcaggaaatcactgcagaatgaaggaacatcccttgaggtgacccagcaaacctgtggccagaaggaggattgtaccttgaaaagacactgaaagcattttggggtgtgaagtaagggtgggcagaggaggtagaaaataattcaattgtcgcatcattcatggttctttaatactgatgctcagtgcattggccttagaatatcccagcctctcttctggtttggtgagtgctgtgtaaataagcatggtagaattgtttggagacatatatagtgatccttggtcactggtgtttcaaacattctggaaagtcacatcgatcaagaatattttttatttttaagaaagcataaccagcaataaaaatactatttttgagtctaaa

SEQ ID NO: 151155 - DNA, 1642 bp, Homo sapiens
  Payload ID: 9774
  Gene Symbol: HLA-DQB1
  Gene Name: major histocompatibility complex, class II, DQ beta 1
  Uniprot ID: P01920
  ENST ID: ENST00000416192
  CDS Start-End: 88-873
acaggtttttattctttctgccaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtcccccgagatcagagtcctacagtggctgtcacgcagccaccaggtcatctcctttcatccccacctcaaggctgatggctgtgaccctgcttcctgcactgacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaattttgggtgcaaagtcagggtgggcagaggaggtagaagatcaactcagttgtcgcatcattcatggttctttcatattgatgttcaatgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtattatttttgagtctaaa

SEQ ID NO: 151156 - DNA, 1732 bp, Homo sapiens
  Payload ID: 9774
  Gene Symbol: HLA-DQB1
  Gene Name: major histocompatibility complex, class II, DQ beta 1
  Uniprot ID: P01920
  ENST ID: ENST00000424806
  CDS Start-End: 177-962
aggatggattagaggcctctattctgagggacactgaggtgggggctgaggaaggacattgagggcagcttcaggtctctctgcctactcttccttgccccaactccattccaggtgtacatcagatccatcaggtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 151157 - DNA, 1787 bp, Homo sapiens
  Payload ID: 9774
  Gene Symbol: HLA-DQB1
  Gene Name: major histocompatibility complex, class II, DQ beta 1
  ENST ID: ENST00000421888
  CDS Start-End: 208-1017
gcactggattcagaaccttcacacaaaaaaaatctgcccagagacagatgaggtccttcagctccagtgctgattggttcctttccaagggaccatccaatcctaccacgcatggaaacatccacagatttttattctttctgccaggtacatcagatccatcaggtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaaggacctcaagggcctccaccagcagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 151158 - DNA, 1485 bp, Homo sapiens
  Payload ID: 9774
  Gene Symbol: HLA-DQB1
  Gene Name: major histocompatibility complex, class II, DQ beta 1
  ENST ID: ENST00000424530
  CDS Start-End: 42-716
gagctgtgttgactaccactacttttcccttcgtctcaattatgtcttggaaaaaggctttgcggatccccggaggccttcgggcagcaactgttaccttgatgctggcgatgctgagcaccccagtggctgagggcagagactctcccgaggatttcgtgtaccagtttaaggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagcaccccagcctccagaaccccatcaccgtggagtggcggctcctgcactgactcctgagactattttaactgggattggttatcacttttctgtaacgcctgcttgtccctgcccagaattcccaactgcctgtgtcagcctgtccccctgagatcagagtcctacagtggctgtcacgcagccaccaggtcatctcctttcatccccaccccaaggcgctggctgtgactctgcttcctgcactgacccagagcctctgcctgtgcatggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 151159 - DNA, 1483 bp, Homo sapiens
  Payload ID: 9774
  Gene Symbol: HLA-DQB1
  Gene Name: major histocompatibility complex, class II, DQ beta 1
  ENST ID: ENST00000415926
  CDS Start-End: 39-713
gagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 151160 - DNA, 1734 bp, Homo sapiens
  Payload ID: 9774
  Gene Symbol: HLA-DQB1
  Gene Name: major histocompatibility complex, class II, DQ beta 1
  Uniprot ID: P01920
  ENST ID: ENST00000422950
  CDS Start-End: 180-965
aggatgcattagaggcctctatcctgagggacactgatgtgggggctgaggaaggacattgagggcaccttcaggtctctctgcctattattccttgtgccaactccattccaggtgtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtcccccgagatcagagtcctacagtggctgtcacgcagccaccaggtcatctcctttcatccccacctcaaggctgatggctgtgaccctgcttcctgcactgacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaattttgggtgcaaagtcagggtgggcagaggaggtagaagatcaactcagttgtcgcatcattcatggttctttcatattgatgttcaatgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtattatttttgagtctaaa

SEQ ID NO: 151161 - DNA, 1219 bp, Homo sapiens
  Payload ID: 9774
  Gene Symbol: HLA-DQB1
  Gene Name: major histocompatibility complex, class II, DQ beta 1
  ENST ID: ENST00000433936
  CDS Start-End: 46-450
gtccgagctgtgttgactaccactacttttcccttcgtctcaattatgtcttggaaaaaggctttgcggatccccggaggccttcgggcagcaactgttaccttgatgctggcgatgctgagcaccccagtggctgagggcagagactctcccgtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagcaccccagcctccagaaccccatcaccgtggagtggcggctcctgcactgactcctgagactattttaactgggattggttatcacttttctgtaacgcctgcttgtccctgcccagaattcccaactgcctgtgtcagcctgtccccctgagatcagagtcctacagtggctgtcacgcagccaccaggtcatctcctttcatccccaccccaaggcgctggctgtgactctgcttcctgcactgacccagagcctctgcctgtgcatggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 151162 - DNA, 484 bp, Homo sapiens
  Payload ID: 9774
  Gene Symbol: HLA-DQB1
  Gene Name: major histocompatibility complex, class II, DQ beta 1
  ENST ID: ENST00000457445
  CDS Start-End: 51-484
atcaggtccgagctgtgttgactaccactacttttcccttcgtctcaattatgtcttggaaaaaggctttgcggatccccggaggccttcgggcagcaactgtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagca

SEQ ID NO: 151163 - DNA, 1423 bp, Homo sapiens
  Payload ID: 9774
  Gene Symbol: HLA-DQB1
  Gene Name: major histocompatibility complex, class II, DQ beta 1
  ENST ID: ENST00000490862
  CDS Start-End: 32-442
gactaccactacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgaggaacggtgactggaccttccagatcctggtgatgctggaaatgactccccagcgtggagacgtctacacctgccacgtggagcaccccagcctccagaaccccatcatcgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtcccccgagatcagagtcctacagtggctgtcacgcagccaccaggtcatctcctttcatccccacctcaaggctgatggctgtgaccctgcttcctgcactgacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaattttgggtgcaaagtcagggtgggcagaggaggtagaagatcaactcagttgtcgcatcattcatggttctttcatattgatgttcaatgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtattatttttgagtctaaa

SEQ ID NO: 151164 - DNA, 1421 bp, Homo sapiens
  Payload ID: 9774
  Gene Symbol: HLA-DQB1
  Gene Name: major histocompatibility complex, class II, DQ beta 1
  ENST ID: ENST00000473366
  CDS Start-End: 29-439
gactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 151165 - DNA, 1423 bp, Homo sapiens
  Payload ID: 9774
  Gene Symbol: HLA-DQB1
  Gene Name: major histocompatibility complex, class II, DQ beta 1
  ENST ID: ENST00000480749
  CDS Start-End: 32-442
gactaccactacttttcccttcgtctcaattatgtcttggaaaaaggctttgcggatccccggaggccttcgggcagcaactgttaccttgatgctggcgatgctgagcaccccagtggctgagggcagagactctcccgaggatttcgtgtaccagtttaaggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgaggaacggtgactggaccttccagatcctggtgatgctggaaatgactccccagcatggagacgtctacacctgccacgtggagcaccccagcctccagaaccccatcaccgtggagtggcgggctcagtctgaatctgcccagagcaagatgctgagtggcattggaggcttcgtgctggggctcatcttcctcgggctgggccttattatccatcacaggagtcagaaagggctcctgcactgactcctgagactattttaactgggattggttatcacttttctgtaacgcctgcttgtccctgcccagaattcccaactgcctgtgtcagcctgtccccctgagatcagagtcctacagtggctgtcacgcagccaccaggtcatctcctttcatccccaccccaaggcgctggctgtgactctgcttcctgcactgacccagagcctctgcctgtgcatggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaa

SEQ ID NO: 151166 - DNA, 783 bp, Homo sapiens
  Payload ID: 9774
  Gene Symbol: HLA-DQB1
  Gene Name: major histocompatibility complex, class II, DQ beta 1
  ENST ID: ENST00000484729
  CDS Start-End: 32-442
gactaccactgcttttcccttcgtctcagttatgtcttggaagaaggctttgcggatccccggagaccttcgggtagcaactgtcaccttgatgctggcgatgctgagctccctactggctgagggcagagactctcccgaggatttcgtgttccagtttaagggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagaggaatggtgactggactttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaagggcttctgcactgactcctgagactattttaactaggattggttatcactcttctgtgatgcctgcttatgcctgcccagaattcccagctgcctgtgtcagcttgtccccctgagatcaaagtcctacagtggctgtcacgc

SEQ ID NO: 151167 - DNA, 2028 bp, Homo sapiens
  Payload ID: 9775
  Gene Symbol: HLA-DQB2
  Gene Name: major histocompatibility complex, class II, DQ beta 2
  ENST ID: ENST00000323109
  CDS Start-End: 51-890
attaggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgggtggtgttggaggcttcgtgctggggctgatcttcctcgggctgggccttatcatccgtcacaggggtcagaaaggacctcgagggcctccacctgcaggtaatatttcagccatgatccagtcaggggagagggcacaggcataagagggaagagccatggtgaaaccgcatctctactaaaaatacaaaaattagctggacgtggtggtgtgcatctgtaatcccggctacttgggaggttgaggcaagagaatcacttgaacccaggaggcagaggttgcagtgagccaagatggcgccactgcactccagtctgggcgatagagctagagtctgtctcaaaaaaaaaaaaaagaagagcatgagcggagtgttccagggcacagtggtctctgttcatggcctgtttgctgctatgagggttaagacttaggggagaagtttgccagtttctacgaatctccagagattgtttcctagaaccaggccttaactttggtggcatctttttgtgaaatgtggggacagagccacatcttgaatgtgagatagtagggtgatgcccactttgtgccacattttgttagctactgcctgtaggcattttcagtgactaaaagaggctgctagtggtggagatgaagtgtcacccaatttgctaaaaaaatcaaactcttcatattacccagaagggtaactgctgttccccgacctccacatatctgcatcaagctgaagttctgtgtcctcatgagctgattttacctttacacagatattggggaacgtgatgatgatatgccctggacctcagcatcctctgtttgatgctgcagaggaaactgaggactgggggagagggtgtgtccctcagggtaccctgtgctgaccatgcctcgtctctcttctccaggactcctgcactgactcctgaggacttttgtctgggattggtcatcactcttctttaatgcccacctgcccctgcccagaattcctagctgcctgtttcaccctgtcccactgaggtcagagtcctacagtggctcatgcagccacaggtcaccttctgtgatccccaccccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 151168 - DNA, 1059 bp, Homo sapiens
  Payload ID: 9775
  Gene Symbol: HLA-DQB2
  Gene Name: major histocompatibility complex, class II, DQ beta 2
  ENST ID: ENST00000399658
  CDS Start-End: 9-704
tctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccacctgcaggactcctgcactgactcctgaggacttttgtctgggattggtcatcactcttctttaatgcccacctgcccctgcccagaattcctagctgcctgtttcaccctgtcccactgaggtcagagtcctacagtggctcatgcagccacaggtcaccttctgtgatccccaccccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 151169 - DNA, 1214 bp, Homo sapiens
  Payload ID: 9775
  Gene Symbol: HLA-DQB2
  Gene Name: major histocompatibility complex, class II, DQ beta 2
  Uniprot ID: P05538
  ENST ID: ENST00000399661
  CDS Start-End: 53-859
ccattaggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgggtggtgttggaggcttcgtgctggggctgatcttcctcgggctgggccttatcatccgtcacaggggtcagaaaggacctcgagggcctccacctgcaggactcctgcactgactcctgaggacttttgtctgggattggtcatcactcttctttaatgcccacctgcccctgcccagaattcctagctgcctgtttcaccctgtcccactgaggtcagagtcctacagtggctcatgcagccacaggtcaccttctgtgatccccaccccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 151170 - DNA, 2027 bp, Homo sapiens
  Payload ID: 9775
  Gene Symbol: HLA-DQB2
  Gene Name: major histocompatibility complex, class II, DQ beta 2
  ENST ID: ENST00000415137
  CDS Start-End: 63-890
attaggtttgagctgtgttgactaccactgctttttccttggtctcacttacgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcagtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgagtggcattggaggcttcgtgctggggctgatcttcctcgggctgggccttatcatccgtcacaggggtcagaaaggacctcgagggcctccaccagcaggtaatatttcagccatgatccagtcaggggagagggcacaggcataagagggaagagccatggtgaaaccgcatctctactaaaaatacaaaaattagctggacgtggtggtgtgcatctgtaatcccggctacttgggaggttgaggcaagagaatcacttgaacccaggaggcagaggttgcagtgagccaagatggcgccactgcactccagtctgggcgatagagctagagtctgtctcaaaaaaaaaaaaagaagagcatgagcggagtgttccagggcacagtggtctctgttcatggcctgtttgctgctatgagggttaagacttaggggaaaagtttgccagtttctacgaatctccagagattgtttcctagaaccaggccttaactttggtggcatctttttgtgaaatgtggggacagagccacatcttgaatgtgagatagtagggtgatgcccactttgtgccacattttgttagctactgcctgtaggcattttcagtgactaaaagaggctgctagtggtggagatgaagtgtcacccaatttactaaaaaaatcaaactcttcatattacccagaagggtaactgctgttcccccacctccacatatctgcatcaagctgaagttctgtgtcctcatgagctgattttacctttacacagatattggggaacgtgatgatgatatgccctggacctcagcatcctctgtttgatgctacagagggaactgaggactaggggagagggtgtgtccctcagggtaccctgtgctgatcatgcctcgtctctcttctccaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 151171 - DNA, 1214 bp, Homo sapiens
  Payload ID: 9775
  Gene Symbol: HLA-DQB2
  Gene Name: major histocompatibility complex, class II, DQ beta 2
  ENST ID: ENST00000429783
  CDS Start-End: 65-859
ccattaggtttgagctgtgttgactaccactgctttttccttggtctcacttacgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcagtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgagtggcattggaggcttcgtgctggggctgatcttcctcgggctgggccttatcatccgtcacaggggtcagaaaggacctcgagggcctccaccagcaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 151172 - DNA, 1214 bp, Homo sapiens
  Payload ID: 9775
  Gene Symbol: HLA-DQB2
  Gene Name: major histocompatibility complex, class II, DQ beta 2
  Uniprot ID: P05538
  ENST ID: ENST00000430849
  CDS Start-End: 53-859
ccattaggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgggtggtgttggaggcttcgtgctggggctgatcttcctcgggctgggccttatcatccgtcacaggggtcagaaaggacctcgagggcctccacctgcaggactcctgcactgactcctgaggacttttgtctgggattggtcatcactcttctgtaatgcccacctgcccctgcccagaattcctagctgcctgtgtcatcctgtcccactgaggtcagagtcctacagtggctcatgcagccacaggtcaccttctgtgatccccatcccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctaactttagtgctttttcccataattaaacctgattctgagtta

SEQ ID NO: 151173 - DNA, 1059 bp, Homo sapiens
  Payload ID: 9775
  Gene Symbol: HLA-DQB2
  Gene Name: major histocompatibility complex, class II, DQ beta 2
  Uniprot ID: P05538
  ENST ID: ENST00000411527
  CDS Start-End: 21-704
tctcacttacgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccaccagcaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 151174 - DNA, 2027 bp, Homo sapiens
  Payload ID: 9775
  Gene Symbol: HLA-DQB2
  Gene Name: major histocompatibility complex, class II, DQ beta 2
  ENST ID: ENST00000433801
  CDS Start-End: 51-890
attaggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgggtggtgttggaggcttcgtgctggggctgatcttcctcgggctgggccttatcatccgtcacaggggtcagaaaggacctcgagggcctccacctgcaggtaatatttcagccatgatccagtcaggggagagggcacaggcataagagggaagagccatggtgaaaccgcatctctactaaaaatacaaaaattagctggacgtggtggtgtgcatctgtaatcccggctacttgggaggttgaggcaagagaatcacttgaacccaggaggcagaggttgcagtgagccaagatggcgccactgcactccagtctgggcgatagagctagagtctgtctcaaaaaaaaaaaaaagaagagcatgagcggagtgttccagggcacagtggtctctgttcatggcctgtttgctgctatgagggttaagacttaggggagaagtttgccagtttctacgaatctccagagattgtttcctagaaccaggccttaactttggtggcatctttttgtgaaatgtggggacagagccacatcttgaatgtgagatagtagggtgatgcccactttgtgccacattttgttagctactgcctgtaggcattttcagtgactaaaagaggctgctagtggtggagatgaagtgtcacccaatttactaaaaaaatcaaactcttcatattacccagaagggtaactgctgttcccccacctccacatatctgcatcaagctgaagttctgtgtcctcatgagctgattttacctttacacagatattggggaacgtgatgatgatatgccctggacctcagcatcctctgtttgatgctgcagaggaaactcaggactgggggagagggtgtgtccctcagggtaccctgtgctgatcatgcctcatctctcttctccaggactcctgcactgactcctgaggacttttgtctgggattggtcatcactcttctgtaatgcccacctgcccctgcccagaattcctagctgcctgtgtcatcctgtcccactgaggtcagagtcctacagtggctcatgcagccacaggtcaccttctgtgatccccatcccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctaactttagtgctttttcccataattaaacctgattctgagtt

SEQ ID NO: 151175 - DNA, 1214 bp, Homo sapiens
  Payload ID: 9775
  Gene Symbol: HLA-DQB2
  Gene Name: major histocompatibility complex, class II, DQ beta 2
  ENST ID: ENST00000430668
  CDS Start-End: 65-859
ccattaggtttgagctgtgttgactaccactgctttttccttggtctcacttacgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgagtggcattggaggcttcgtgctggggctgatcttcctcgggctgggccttatcatccgtcacaggggtcagaaaggacctcgagggcctccaccagcaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 151176 - DNA, 1059 bp, Homo sapiens; identical to SEQ ID NO: 151173
  Payload ID: 9775
  Gene Symbol: HLA-DQB2
  Gene Name: major histocompatibility complex, class II, DQ beta 2
  Uniprot ID: P05538
  ENST ID: ENST00000426733
  CDS Start-End: 21-704

SEQ ID NO: 151177 - DNA, 1059 bp, Homo sapiens
  Payload ID: 9775
  Gene Symbol: HLA-DQB2
  Gene Name: major histocompatibility complex, class II, DQ beta 2
  ENST ID: ENST00000417780
  CDS Start-End: 9-704
tctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccacctgcaggactcctgcactgactcctgaggacttttgtctgggattggtcatcactcttctgtaatgcccacctgcccctgcccagaattcctagctgcctgtgtcatcctgtcccactgaggtcagagtcctacagtggctcatgcagccacaggtcaccttctgtgatccccatcccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctaactttagtgctttttcccataattaaacctgattctgagtta

SEQ ID NO: 151178 - DNA, 2027 bp, Homo sapiens; identical to SEQ ID NO: 151174
  Payload ID: 9775
  Gene Symbol: HLA-DQB2
  Gene Name: major histocompatibility complex, class II, DQ beta 2
  ENST ID: ENST00000442043
  CDS Start-End: 51-890

SEQ ID NO: 151179 - DNA, 2026 bp, Homo sapiens
  Payload ID: 9775
  Gene Symbol: HLA-DQB2
  Gene Name: major histocompatibility complex, class II, DQ beta 2
  ENST ID: ENST00000442806
  CDS Start-End: 63-890
attaggtttgagctgtgttgactaccactgctttttccttggtctcacttacgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgagtggcattggaggcttcgtgctggggctgatcttcctcgggctgggccttatcatccgtcacaggggtcagaaaggacctcgagggcctccaccagcaggtaatatttcagccatgatccagtcaggggagagggcacaggcataagagggaagagccatggtgaaaccgcatctctactaaaaatacaaaaattagctggacgtggtggtgtgcatctgtaatcccggctacttgggaggttgaggcaagagaatcacttgaacccaggaggcagaggttgcagtgagccaagatggcgccactgcactccagtctgggcgatagagctagagtctgtctcaaaaaaaaaaaagaagagcatgagcggagtgttccagggcacagtggtctctgttcatggcctgtttgctgctatgagggttaagacttaggggaaaagtttgccagtttctacgaatctccagagattgtttcctagaaccaggccttaactttggtggcatctttttgtgaaatgtggggacagagccacatcttgaatgtgagatagtagggtgatgcccactttgtgccacattttgttagctactgcctgtaggcattttcagtgactaaaagaggctgctagtggtggagatgaagtgtcacccaatttactaaaaaaatcaaactcttcatattacccagaagggtaactgctgttcccccacctccacatatctgcatcaagctgaagttctgtgtcctcatgagctgattttacctttacacagatattggggaacgtgatgatgatatgccctggacctcagcatcctctgtttgatgctacagagggaactgaggactaggggagagggtgtgtccctcagggtaccctgtgctgatcatgcctcgtctctcttctccaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 151180 - DNA, 721 bp, Homo sapiens
  Payload ID: 9775
  Gene Symbol: HLA-DQB2
  Gene Name: major histocompatibility complex, class II, DQ beta 2
  ENST ID: ENST00000416131
  CDS Start-End: 1-656
ctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgactcctgcactgactcctgaggacttttgtctgggattggtcatcactcttctttaatgcccacctgcccctgcccag

SEQ ID NO: 151181 - DNA, 1214 bp, Homo sapiens; identical to SEQ ID NO: 151175
  Payload ID: 9775
  Gene Symbol: HLA-DQB2
  Gene Name: major histocompatibility complex, class II, DQ beta 2
  ENST ID: ENST00000437316
  CDS Start-End: 65-859

SEQ ID NO: 151182 - DNA, 1214 bp, Homo sapiens; identical to SEQ ID NO: 151169
  Payload ID: 9775
  Gene Symbol: HLA-DQB2
  Gene Name: major histocompatibility complex, class II, DQ beta 2
  Uniprot ID: P05538
  ENST ID: ENST00000457432
  CDS Start-End: 53-859

SEQ ID NO: 151183 - DNA, 721 bp, Homo sapiens
  Payload ID: 9775
  Gene Symbol: HLA-DQB2
  Gene Name: major histocompatibility complex, class II, DQ beta 2
  ENST ID: ENST00000447979
  CDS Start-End: 1-656
ctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgactcctgcactgactcctgaggacttttgtctgggattggtcatcactcttctgtaatgcccacctgcccctgcccag

SEQ ID NO: 151184 - DNA, 1059 bp, Homo sapiens
  Payload ID: 9775
  Gene Symbol: HLA-DQB2
  Gene Name: major histocompatibility complex, class II, DQ beta 2
  Uniprot ID: P05538
  ENST ID: ENST00000456529
  CDS Start-End: 21-704
tctcacttacgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcagtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccaccagcaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 151185 - DNA, 1059 bp, Homo sapiens; identical to SEQ ID NO: 151168
  Payload ID: 9775
  Gene Symbol: HLA-DQB2
  Gene Name: major histocompatibility complex, class II, DQ beta 2
  ENST ID: ENST00000433114
  CDS Start-End: 9-704

SEQ ID NO: 151186 - DNA, 721 bp, Homo sapiens; identical to SEQ ID NO: 151183
  Payload ID: 9775
  Gene Symbol: HLA-DQB2
  Gene Name: major histocompatibility complex, class II, DQ beta 2
  ENST ID: ENST00000424579
  CDS Start-End: 1-656

SEQ ID NO: 151187 - DNA, 721 bp, Homo sapiens
  Payload ID: 9775
  Gene Symbol: HLA-DQB2
  Gene Name: major histocompatibility complex, class II, DQ beta 2
  ENST ID: ENST00000421468
  CDS Start-End: 1-656
ctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcagtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgactcctgcactgactcctgaggacttttgtctgggattggtcatcactcttctgtaatgcccacctgcccctgcccag

SEQ ID NO: 151188 - DNA, 721 bp, Homo sapiens
  Payload ID: 9775
  Gene Symbol: HLA-DQB2
  Gene Name: major histocompatibility complex, class II, DQ beta 2
  ENST ID: ENST00000435081
  CDS Start-End: 1-656
ctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgactcctgcactgactcctgaggacttttgtctgggattggtcatcactcttctgtaatgcccacctgcccctgcccag

SEQ ID NO: 151189 - DNA, 2028 bp, Homo sapiens; identical to SEQ ID NO: 151167
  Payload ID: 9775
  Gene Symbol: HLA-DQB2
  Gene Name: major histocompatibility complex, class II, DQ beta 2
  ENST ID: ENST00000419519
  CDS Start-End: 51-890

SEQ ID NO: 151190 - DNA, 1059 bp, Homo sapiens; identical to SEQ ID NO: 151177
  Payload ID: 9775
  Gene Symbol: HLA-DQB2
  Gene Name: major histocompatibility complex, class II, DQ beta 2
  ENST ID: ENST00000428972
  CDS Start-End: 9-704

SEQ ID NO: 151191 - DNA, 1059 bp, Homo sapiens; identical to SEQ ID NO: 151184
  Payload ID: 9775
  Gene Symbol: HLA-DQB2
  Gene Name: major histocompatibility complex, class II, DQ beta 2
  Uniprot ID: P05538
  ENST ID: ENST00000438757
  CDS Start-End: 21-704

SEQ ID NO: 151192 - DNA, 2027 bp, Homo sapiens; identical to SEQ ID NO: 151170
  Payload ID: 9775
  Gene Symbol: HLA-DQB2
  Gene Name: major histocompatibility complex, class II, DQ beta 2
  ENST ID: ENST00000455520
  CDS Start-End: 63-890

SEQ ID NO: 151193 - DNA, 1214 bp, Homo sapiens; identical to SEQ ID NO: 151172
  Payload ID: 9775
  Gene Symbol: HLA-DQB2
  Gene Name: major histocompatibility complex, class II, DQ beta 2
  Uniprot ID: P05538
  ENST ID: ENST00000432486
  CDS Start-End: 53-859

SEQ ID NO: 151194 - DNA, 2026 bp, Homo sapiens; identical to SEQ ID NO: 151179
  Payload ID: 9775
  Gene Symbol: HLA-DQB2
  Gene Name: major histocompatibility complex, class II, DQ beta 2
  ENST ID: ENST00000435145
  CDS Start-End: 63-890

SEQ ID NO: 151195 - DNA, 721 bp, Homo sapiens; identical to SEQ ID NO: 151187
  Payload ID: 9775
  Gene Symbol: HLA-DQB2
  Gene Name: major histocompatibility complex, class II, DQ beta 2
  ENST ID: ENST00000418419
  CDS Start-End: 1-656

SEQ ID NO: 151196 - DNA, 721 bp, Homo sapiens; identical to SEQ ID NO: 151180
  Payload ID: 9775
  Gene Symbol: HLA-DQB2
  Gene Name: major histocompatibility complex, class II, DQ beta 2
  ENST ID: ENST00000419109
  CDS Start-End: 1-656

SEQ ID NO: 151197 - DNA, 721 bp, Homo sapiens; identical to SEQ ID NO: 151188
  Payload ID: 9775
  Gene Symbol: HLA-DQB2
  Gene Name: major histocompatibility complex, class II, DQ beta 2
  ENST ID: ENST00000427449
  CDS Start-End: 1-656

SEQ ID NO: 151198 - DNA, 1214 bp, Homo sapiens; identical to SEQ ID NO: 151171
  Payload ID: 9775
  Gene Symbol: HLA-DQB2
  Gene Name: major histocompatibility complex, class II, DQ beta 2
  ENST ID: ENST00000419685
  CDS Start-End: 65-859

SEQ ID NO: 151199 - DNA, 1169 bp, Homo sapiens
  Payload ID: 9776
  Gene Symbol: HLA-DRA
  Gene Name: major histocompatibility complex, class II, DR alpha
  ENST ID: ENST00000374982
  CDS Start-End: 74-763
ttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagtgtggatatgcctcttcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 151200 - DNA, 1280 bp, Homo sapiens
  Payload ID: 9776
  Gene Symbol: HLA-DRA
  Gene Name: major histocompatibility complex, class II, DR alpha
  Uniprot ID: P01903
  ENST ID: ENST00000383127
  CDS Start-End: 110-874
ttttaatggtcagactctattacaccccacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagagtggttatgcctcctcgattgctccatactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgaagatcttgggtggaa

SEQ ID NO: 151201 - DNA, 1123 bp, Homo sapiens
  Payload ID: 9776
  Gene Symbol: HLA-DRA
  Gene Name: major histocompatibility complex, class II, DR alpha
  ENST ID: ENST00000383258
  CDS Start-End: 28-717
actcccaaaagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 151202 - DNA, 1280 bp, Homo sapiens
  Payload ID: 9776
  Gene Symbol: HLA-DRA
  Gene Name: major histocompatibility complex, class II, DR alpha
  Uniprot ID: P01903
  ENST ID: ENST00000383259
  CDS Start-End: 110-874
ttttaatggtcagactctattacaccccacattctcttttcttttattcttgtctgttctgcctcactcccgagctctactgactcccaaaagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 151203 - DNA, 1280 bp, Homo sapiens
  Payload ID: 9776
  Gene Symbol: HLA-DRA
  Gene Name: major histocompatibility complex, class II, DR alpha
  Uniprot ID: P01903
  ENST ID: ENST00000395388
  CDS Start-End: 110-874
ttttaatggtcagactctattacaccccacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacaaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagtgtggatatgcctcttcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 151204 - DNA, 1123 bp, Homo sapiens
  Payload ID: 9776
  Gene Symbol: HLA-DRA
  Gene Name: major histocompatibility complex, class II, DR alpha
  ENST ID: ENST00000415767
  CDS Start-End: 28-717
actcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 151205 - DNA, 1123 bp, Homo sapiens; identical to SEQ ID NO: 151201
  Payload ID: 9776
  Gene Symbol: HLA-DRA
  Gene Name: major histocompatibility complex, class II, DR alpha
  ENST ID: ENST00000427753
  CDS Start-End: 28-717

SEQ ID NO: 151206 - DNA, 1280 bp, Homo sapiens; identical to SEQ ID NO: 151202
  Payload ID: 9776
  Gene Symbol: HLA-DRA
  Gene Name: major histocompatibility complex, class II, DR alpha
  Uniprot ID: P01903
  ENST ID: ENST00000414698
  CDS Start-End: 110-874

SEQ ID NO: 151207 - DNA, 1123 bp, Homo sapiens
  Payload ID: 9776
  Gene Symbol: HLA-DRA
  Gene Name: major histocompatibility complex, class II, DR alpha
  ENST ID: ENST00000434866
  CDS Start-End: 28-717
actcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagagtggttatgcctcctcgattgctccatactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgaagatcttgggtggaa

SEQ ID NO: 151208 - DNA, 1280 bp, Homo sapiens
  Payload ID: 9776
  Gene Symbol: HLA-DRA
  Gene Name: major histocompatibility complex, class II, DR alpha
  Uniprot ID: P01903
  ENST ID: ENST00000442960
  CDS Start-End: 110-874
ttttaatggtcagactctattacaccccacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 151209 - DNA, 1280 bp, Homo sapiens; identical to SEQ ID NO: 151202
  Payload ID: 9776
  Gene Symbol: HLA-DRA
  Gene Name: major histocompatibility complex, class II, DR alpha
  Uniprot ID: P01903
  ENST ID: ENST00000411524
  CDS Start-End: 110-874

SEQ ID NO: 151210 - DNA, 1280 bp, Homo sapiens
  Payload ID: 9776
  Gene Symbol: HLA-DRA
  Gene Name: major histocompatibility complex, class II, DR alpha
  Uniprot ID: P01903
  ENST ID: ENST00000416883
  CDS Start-End: 110-874
ttttaatggtcagactctattacaccccacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaatgtggtgtgtgccctgggcctgactgtgggtctggtgggcatcattattgggaccatcttcatcatcaagggagtgcgcaaaagcaatgcagcagaacgcagggggcctctgtaaggcacatggaggtgatgatgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 151211 - DNA, 1123 bp, Homo sapiens
  Payload ID: 9776
  Gene Symbol: HLA-DRA
  Gene Name: major histocompatibility complex, class II, DR alpha
  ENST ID: ENST00000411505
  CDS Start-End: 28-717
actcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaatgtggtgtgtgccctgggcctgactgtgggtctggtgggcatcattattgggaccatcttcatcatcaagggagtgcgcaaaagcaatgcagcagaacgcagggggcctctgtaaggcacatggaggtgatgatgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 151212 - DNA, 1123 bp, Homo sapiens; identical to SEQ ID NO: 151201
  Payload ID: 9776
  Gene Symbol: HLA-DRA
  Gene Name: major histocompatibility complex, class II, DR alpha
  ENST ID: ENST00000418111
  CDS Start-End: 28-717

SEQ ID NO: 151213 - DNA, 1278 bp, Homo sapiens
  Payload ID: 9776
  Gene Symbol: HLA-DRA
  Gene Name: major histocompatibility complex, class II, DR alpha
  ENST ID: ENST00000613328
  CDS Start-End: 110-874
ttttaatggtcagactctattacaccccacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacaaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagtgtggatatgcctcttcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtgg

SEQ ID NO: 151214 - DNA, 1230 bp, Homo sapiens
  Payload ID: 9777
  Gene Symbol: HLA-DRB1
  Gene Name: major histocompatibility complex, class II, DR beta 1
  Uniprot ID: P01912
  ENST ID: ENST00000328980
  CDS Start-End: 107-907
agtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgagtccatcctaaggtgactgtgtatccttcaaagacccagcccctgcagcaccataacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgttcttggcctgaagccccacagctttgatggcagtgcctcatcttcaacttttgtgctcccctttgcctaaaccctatggcctcctgtgcatctgtactcaccctgtaccacaaacacattacattattaaatgtttctcaaagatggagttaaa

SEQ ID NO: 151215 - DNA, 1229 bp, Homo sapiens
  Payload ID: 9777
  Gene Symbol: HLA-DRB1
  Gene Name: major histocompatibility complex, class II, DR beta 1
  Uniprot ID: P04229
  ENST ID: ENST00000360004
  CDS Start-End: 107-907
agtaacttcctccctataacttggaatgtgggtggaggggttcatagttctccctgagtgagacttgcctgcttctctggcccctggtcctgtcctgttctccagcatggtgtgtctgaagctccctggaggctcctgcatgacagcgctgacagtgacactgatggtgctgagctccccactggctttgtctggggacacccgaccacgtttcctgtggcagcctaagagggagtgtcatttcttcaatgggacggagcgggtgcggttcctggacagatacttctataaccaggaggagtccgtgcgcttcgacagcgacgtgggggagttccgggcggtgacggagctggggcggcctgacgctgagtactggaacagccagaaggacatcctggagcaggcgcgggccgcggtggacacctactgcagacacaactacggggttgtggagagcttcacagtgcagcggcgagtccaacctaaggtgactgtatatccttcaaagacccagcccctgcagcaccacaacctcctggtctgctctgtgagtggtttctatccaggcagcattgaagtcaggtggttcctgaacggccaggaagagaaggctgggatggtgtccacaggcctgatccagaatggagactggaccttccagaccctggtgatgctggaaacagttcctcgaagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaaatgcagatgaccacattcaaggaagaactttctgccccggctttgcaggatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatggcagcgcctcatcttcaacttttgtgctcccctttgcctaaaccgtatggcctcccgtgcatctgtattcaccctgtatgacaaacacattacattattaaatgtttctcaaagatggagttaaa

SEQ ID NO: 151216 - DNA, 1230 bp, Homo sapiens; identical to SEQ ID NO: 151214
  Payload ID: 9777
  Gene Symbol: HLA-DRB1
  Gene Name: major histocompatibility complex, class II, DR beta 1
  Uniprot ID: P01912
  ENST ID: ENST00000399450
  CDS Start-End: 107-907

SEQ ID NO: 151217 - DNA, 753 bp, Homo sapiens
  Payload ID: 9777
  Gene Symbol: HLA-DRB1
  Gene Name: major histocompatibility complex, class II, DR beta 1
  Uniprot ID: Q95IE3
  ENST ID: ENST00000428566
  CDS Start-End: 1-753
cccttttaaaactcaccagggacttcccacagaggcatgaaaaatatcagtcctgggcagggactttccacctatgtctgaaaaagaacaagtatcctgattcacgctctacattcattaagcatgctggatcttacttgaaaaggggagagttcttggcaatccacacagctatcacctgtttctttcgacaaatttcagcacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgagtccatcctaaggtgactgtgtatccttcaaagacccagcccctgcagcaccataacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatgga

SEQ ID NO: 151218 - DNA, 749 bp, Homo sapiens
  Payload ID: 9777
  Gene Symbol: HLA-DRB1
  Gene Name: major histocompatibility complex, class II, DR beta 1
  ENST ID: ENST00000433975
  CDS Start-End: 1-749
ctcttttaaaactcaccagggacttcccacagaggcatgaaaaatatcagtcctgggcagggactttccacctatgtctgaaaaagaacaagtatcctgattcacgctctacattcattaagcatgctggatcttacttgaaaaggggagagttcttgtcaatccacacagctatcacctgtttctttctacaaatttcagcacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaa

SEQ ID NO: 151219 - DNA, 1191 bp, Homo sapiens
  Payload ID: 9777
  Gene Symbol: HLA-DRB1
  Gene Name: major histocompatibility complex, class II, DR beta 1
  Uniprot ID: P13760
  ENST ID: ENST00000419393
  CDS Start-End: 64-864
atagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttgtggagagcttcacagtgcagcggcgagtctatcctgaggtgactgtgtatcctgcaaagacccagcccctgcagcaccacaacctcctggtctgctctgtgaatggtttctatccaggcagcattgaagtcaggtggttccggaacggccaggaagagaagactggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcagctctgcagaaaatgtcctcccttgtggctgcctcagctcgtacctttggcctgaagtcccagcattaatggcagcccctcatcttccaagttttgtgctcccctttacctaatgcttcctgcctcccatgcatctgtactcctgctgtgccacaaacacattacattattaaatgtttctcaaacatggagttaaaaa

SEQ ID NO: 151220 - DNA, 1235 bp, Homo sapiens
  Payload ID: 9777
  Gene Symbol: HLA-DRB1
  Gene Name: major histocompatibility complex, class II, DR beta 1
  Uniprot ID: P13761
  ENST ID: ENST00000437784
  CDS Start-End: 108-908
agtaacttcttccctataatttggaatgtgggtggagaggggtcatagttctccctgagtgagactcacctgctcctctggcccctggtcctgtcctgttctccagcatggtgtgtctgaagctccctggaggctcctgcatggcagctctgacagtgacactgatggtgctgagctccccactggctttggctggggacacccaaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatggagttaaaaa

SEQ ID NO: 151221 - DNA, 751 bp, Homo sapiens
  Payload ID: 9777
  Gene Symbol: HLA-DRB1
  Gene Name: major histocompatibility complex, class II, DR beta 1
  Uniprot ID: Q95IE3
  ENST ID: ENST00000412634
  CDS Start-End: 1-751
cttttaaaactcaccagggacttcccacagaggcatgaaaaatatcagtcctgggcagggactttccacctatgtctgaaaaagaacaagtatcctgattcacgctctacattcattaagcatgctggatcttacttgaaaaggggagagttcttgtcaatccacacagctatcacctgtttctttctacaaatttcagcacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttgtggagagcttcacagtgcagcggcgagtctatcctgaggtgactgtgtatcctgcaaagacccagcccctgcagcaccacaacctcctggtctgctctgtgaatggtttctatccaggcagcattgaagtcaggtggttccggaacggccaggaagagaagactggggtggtgtccacaggcctgatccagaatggagactggaccttccagaccctggtgatgctggaaacagttcctcggagtggagaggtttacacctgccaagtggagcacccaagcctgacgagccctctcacagtggaatgga

SEQ ID NO: 151222 - DNA, 1180 bp, Homo sapiens
  Payload ID: 9777
  Gene Symbol: HLA-DRB1
  Gene Name: major histocompatibility complex, class II, DR beta 1
  Uniprot ID: P13761
  ENST ID: ENST00000444645
  CDS Start-End: 61-861
gttctccctgagtgagactcacctgctcctctggcccctggtcctgtcctgttctccagcatggtgtgtctgaagctccctggaggctcctgcatggcagctctgacagtgacactgatggtgctgagctccccactggctttggctggggacacccaaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatgga

SEQ ID NO: 151223 - DNA, 753 bp, Homo sapiens; identical to SEQ ID NO: 151217
  Payload ID: 9777
  Gene Symbol: HLA-DRB1
  Gene Name: major histocompatibility complex, class II, DR beta 1
  Uniprot ID: Q95IE3
  ENST ID: ENST00000415796
  CDS Start-End: 1-753

SEQ ID NO: 151224 - DNA, 998 bp, Homo sapiens
  Payload ID: 9777
  Gene Symbol: HLA-DRB1
  Gene Name: major histocompatibility complex, class II, DR beta 1
  ENST ID: ENST00000553034
  CDS Start-End: 27-827
cccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttgtggagagcttcacagtgcagcggcgagtctatcctgaggtgactgtgtatcctgcaaagacccagcccctgcagcaccacaacctcctggtctgctctgtgaatggtttctatccaggcagcattgaagtcaggtggttccggaacggccaggaagagaagactggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggactcctgagctgaagtgaagatgaccacattcaaggaggaaccttcttccccagctttgcaggatgaaaagctttcccacctggctgttattcttccataagagagggctttctcaggatctggttgctactggttcagcaactctgcagaaaatgtcctcccttgtggcttcctcagcccctg

SEQ ID NO: 151225 - DNA, 878 bp, Homo sapiens
  Payload ID: 9777
  Gene Symbol: HLA-DRB1
  Gene Name: major histocompatibility complex, class II, DR beta 1
  ENST ID: ENST00000548953
  CDS Start-End: 24-833
ccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgaggtgagcctaaggtgactgtgtatccttcaaagacccagcccctgcagcaccataacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgaccacattcaaggaagaaccttctgccccagcttt

SEQ ID NO: 151226 - DNA, 878 bp, Homo sapiens; identical to SEQ ID NO: 151225
  Payload ID: 9777
  Gene Symbol: HLA-DRB1
  Gene Name: major histocompatibility complex, class II, DR beta 1
  ENST ID: ENST00000551970
  CDS Start-End: 24-833

SEQ ID NO: 151227 - DNA, 878 bp, Homo sapiens
  Payload ID: 9777
  Gene Symbol: HLA-DRB1
  Gene Name: major histocompatibility complex, class II, DR beta 1
  ENST ID: ENST00000547498
  CDS Start-End: 24-833
ccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgaggtgagcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagcttt

SEQ ID NO: 151228 - DNA, 878 bp, Homo sapiens
  Payload ID: 9777
  Gene Symbol: HLA-DRB1
  Gene Name: major histocompatibility complex, class II, DR beta 1
  ENST ID: ENST00000548083
  CDS Start-End: 24-833
ctacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggaccgagcgcgtgcggggtgtgaccagatacatctataaccgagaggagtacgcgcgcttcgacagcgacgtgggggtgtatcgggcggtgacgccgctggggccgcctgccgccgagtactggaacagccagaaggaagtcctggagaggacccgggcggagttggacacggtgtgcagacacaactaccagttggagctccgcacgaccttgcagcggcgaggtgagcctgaggtgactgtgtatcctgcaaagacccagcccctgcagcaccacaacctcctggtctgctctgtgaatggtttctatccaggcagcattgaagtcaggtggttccggaacggccaggaagagaagactggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggattcctgagctgaagtgaagatgaccacattcaaggaagaaccttctgccccagcttt

SEQ ID NO: 151229 - DNA, 1138 bp, Homo sapiens
  Payload ID: 9777
  Gene Symbol: HLA-DRB1
  Gene Name: major histocompatibility complex, class II, DR beta 1
  Uniprot ID: P01912
  ENST ID: ENST00000612249
  CDS Start-End: 38-838
tgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgagtccatcctaaggtgactgtgtatccttcaaagacccagcccctgcagcaccataacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatg

SEQ ID NO: 151230 - DNA, 1118 bp, Homo sapiens
  Payload ID: 9777
  Gene Symbol: HLA-DRB1
  Gene Name: major histocompatibility complex, class II, DR beta 1
  ENST ID: ENST00000614039
  CDS Start-End: 36-836
ctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttgtggagagcttcacagtgcagcggcgagtctatcctgaggtgactgtgtatcctgcaaagacccagcccctgcagcaccacaacctcctggtctgctctgtgaatggtttctatccaggcagcattgaagtcaggtggttccggaacggccaggaagagaagactggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaaagctttcccacctggctgttattcttccataagagagggctttctcaggatctggttgctactggttcagcaactctgcagaaaatgtcctcccttgtggcttcctcagctcctgttcttggcctgaagcctcacagctttgatggcagtgcctcatcttcaacttttgtgcttccctttacctaaactgtcctgcctcccgtgcatctgtactccccttgtgcca

SEQ ID NO: 151231 - DNA, 994 bp, Homo sapiens
  Payload ID: 9777
  Gene Symbol: HLA-DRB1
  Gene Name: major histocompatibility complex, class II, DR beta 1
  ENST ID: ENST00000612698
  CDS Start-End: 27-827
cccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgagtccatcctaaggtgactgtgtatccttcaaagacccagcccctgcagcaccataacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctg

SEQ ID NO: 151232 - DNA, 920 bp, Homo sapiens
  Payload ID: 9777
  Gene Symbol: HLA-DRB1
  Gene Name: major histocompatibility complex, class II, DR beta 1
  ENST ID: ENST00000611060
  CDS Start-End: 64-864
atagttctccctgagtgagacttgcctgcttctctggcccctggtcctgtcctgttctccagcatggtgtgtctgaagctccctggaggctcctgcatgacagcgctgacagtgacactgatggtgctgagctccccactggctttgtctggggacacccgaccacgtttcctgtggcagcctaagagggagtgtcatttcttcaatgggacggagcgggtgcggttcctggacagatacttctataaccaggaggagtccgtgcgcttcgacagcgacgtgggggagttccgggcggtgacggagctggggcggcctgacgctgagtactggaacagccagaaggacatcctggagcaggcgcgggccgcggtggacacctactgcagacacaactacggggttgtggagagcttcacagtgcagcggcgaggtgagcctaaggtgactgtatatccttcaaagacccagcccctgcagcaccacaacctcctggtctgctctgtgagtggtttctatccaggcagcattgaagtcaggtggttcctgaacggccaggaagagaaggctgggatggtgtccacaggcctgatccagaatggagactggaccttccagaccctggtgatgctggaaacagttcctcgaagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggactcctgagctgaagtgcacatgaccacattcaaggaagaaccttctgccacagctttgcaggatgaaa

SEQ ID NO: 151233 - DNA, 1155 bp, Homo sapiens
  Payload ID: 9777
  Gene Symbol: HLA-DRB1
  Gene Name: major histocompatibility complex, class II, DR beta 1
  ENST ID: ENST00000621864
  CDS Start-End: 46-846
gacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgagtccatcctaaggtgactgtgtatccttcaaagacccagcccctgcagcaccataacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagtgcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaag

SEQ ID NO: 151234 - DNA, 1219 bp, Homo sapiens
  Payload ID: 9777
  Gene Symbol: HLA-DRB1
  Gene Name: major histocompatibility complex, class II, DR beta 1
  Uniprot ID: P13761
  ENST ID: ENST00000617823
  CDS Start-End: 96-896
cctataatttggaatgtgggtggagaggggtcatagttctccctgagtgagactcacctgctcctctggcccctggtcctgtcctgttctccagcatggtgtgtctgaagctccctggaggctcctgcatggcagctctgacagtgacactgatggtgctgagctccccactggctttggctggggacacccaaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagctttgcaggatgaaaagctttcccacctggctgttattcttccataagagagggctttctcaggatctggttgctactggttcagcaactctgcagaaaatgtcctcccttgtggcttcctcagcccctgcctttggcctgaagtcctggcattgatggcagcacctcatcttcaacttttgtgctcccctttacctaacccttcctgcctcccgtgcatctgtactccccccttgtgccacaaacacattacattattaaatgtttctcacacacggagat

SEQ ID NO: 151235 - DNA, 1219 bp, Homo sapiens; identical to SEQ ID NO: 151234
  Payload ID: 9777
  Gene Symbol: HLA-DRB1
  Gene Name: major histocompatibility complex, class II, DR beta 1
  Uniprot ID: P13761
  ENST ID: ENST00000620951
  CDS Start-End: 96-896

SEQ ID NO: 151236 - DNA, 998 bp, Homo sapiens
  Payload ID: 9777
  Gene Symbol: HLA-DRB1
  Gene Name: major histocompatibility complex, class II, DR beta 1
  ENST ID: ENST00000614473
  CDS Start-End: 27-827
cccctggtcctgtcctgttctccagcatggtgtgtctgaagctccctggaggctcctgcatggcagctctgacagtgacactgatggtgctgagctccccactggctttggctggggacacccaaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggactcctgagctgaagtgaagatgaccacattcaaggaggaaccttcttccccagctttgcaggatgaaaagctttcccacctggctgttattcttccataagagagggctttctcaggatctggttgctactggttcagcaactctgcagaaaatgtcctcccttgtggcttcctcagcccctg

SEQ ID NO: 151237 - DNA, 998 bp, Homo sapiens; identical to SEQ ID NO: 151236
  Payload ID: 9777
  Gene Symbol: HLA-DRB1
  Gene Name: major histocompatibility complex, class II, DR beta 1
  ENST ID: ENST00000621579
  CDS Start-End: 27-827

SEQ ID NO: 151238 - DNA, 878 bp, Homo sapiens
  Payload ID: 9777
  Gene Symbol: HLA-DRB1
  Gene Name: major histocompatibility complex, class II, DR beta 1
  ENST ID: ENST00000615274
  CDS Start-End: 24-833
ctacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgaggtgagcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagcttt

SEQ ID NO: 151239 - DNA, 1219 bp, Homo sapiens
  Payload ID: 9777
  Gene Symbol: HLA-DRB1
  Gene Name: major histocompatibility complex, class II, DR beta 1
  ENST ID: ENST00000613978
  CDS Start-End: 96-896
cctataatttggaatgtgggtggagaggggtcatagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttgtggagagcttcacagtgcagcggcgagtctatcctgaggtgactgtgtatcctgcaaagacccagcccctgcagcaccacaacctcctggtctgctctgtgaatggtttctatccaggcagcattgaagtcaggtggttccggaacggccaggaagagaagactggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaaagctttcccacctggctgttattcttccataagagagggctttctcaggatctggttgctactggttcagcaactctgcagaaaatgtcctcccttgtggcttcctcagcccctgcctttggcctgaagtcctggcattgatggcagcacctcatcttcaacttttgtgctcccctttacctaacccttcctgcctcccgtgcatctgtactccccccttgtgccacaaacacattacattattaaatgtttctcacacacggagat

SEQ ID NO: 151240 - DNA, 1138 bp, Homo sapiens; identical to SEQ ID NO: 151229
  Payload ID: 9777
  Gene Symbol: HLA-DRB1
  Gene Name: major histocompatibility complex, class II, DR beta 1
  Uniprot ID: P01912
  ENST ID: ENST00000621986
  CDS Start-End: 38-838

SEQ ID NO: 151241 - DNA, 1155 bp, Homo sapiens
  Payload ID: 9777
  Gene Symbol: HLA-DRB1
  Gene Name: major histocompatibility complex, class II, DR beta 1
  ENST ID: ENST00000617344
  CDS Start-End: 46-846
gacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgagtccatcctaaggtgactgtgtatccttcaaagacccagcccctgcagcaccataacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagtgcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttctgccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaag

SEQ ID NO: 151242 - DNA, 920 bp, Homo sapiens
  Payload ID: 9777
  Gene Symbol: HLA-DRB1
  Gene Name: major histocompatibility complex, class II, DR beta 1
  ENST ID: ENST00000615998
  CDS Start-End: 64-864
atagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttgtggagagcttcacagtgcagcggcgaggtgagcctgaggtgactgtgtatcctgcaaagacccagcccctgcagcaccacaacctcctggtctgctctgtgaatggtttctatccaggcagcattgaagtcaggtggttccggaacggccaggaagagaagactggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggactcttgagctgaagtgcagatgaccacattcaaggaagaaccttctgccccagctttgcaagatgaaa

SEQ ID NO: 151243 - DNA, 1178 bp, Homo sapiens
  Payload ID: 9778
  Gene Symbol: HLA-DRB3
  Gene Name: major histocompatibility complex, class II, DR beta 3
  Uniprot ID: P79483
  ENST ID: ENST00000307137
  CDS Start-End: 64-864
atagttctccctgagtgagacttgcctgctcctctggcccctggtcctgtcctcttctccagcatggtgtgtctgaagctccctggaggctccagcttggcagcgttgacagtgacactgatggtgctgagctcccgactggctttcgctggggacacccgaccacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacctcctggagcagaagcggggccaggtggacaattactgcagacacaactacggggttggtgagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacctgccaagtggagcacccaagcgtaacgagccctctcacagtggaatggagtgcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatgga

SEQ ID NO: 151244 - DNA, 1207 bp, Homo sapiens
  Payload ID: 9778
  Gene Symbol: HLA-DRB3
  Gene Name: major histocompatibility complex, class II, DR beta 3
  ENST ID: ENST00000383126
  CDS Start-End: 78-878
ggtggaggggggtcatagttctccctgagtgagacttgcctgctcctctggcccctggtcctgtcctcttctccagcatggtgtgtctgaagctccctggaggctccagcttggcagcgttgacagtgacactgatggtgctgagctcccgactggctttcgctggggacacccgaccacgtttcttggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacttgccaagtggagcacccaagcgtaacgagcgctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttctgccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctg

SEQ ID NO: 151245 - DNA, 1839 bp, Homo sapiens
  Payload ID: 9778
  Gene Symbol: HLA-DRB3
  Gene Name: major histocompatibility complex, class II, DR beta 3
  ENST ID: ENST00000426847
  CDS Start-End: 100-900
cctccctataatttggaatgtgggtggaggggggtcatagttctccctgagtgagacttgcctgctcctctggcccctggtcctgtcctcttctccagcatggtgtgtctgaagctccctggaggctccagcttggcagcgttgacagtgacactgatggtgctgagctcccgactggctttcgctggggacacccgaccacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacctcctggagcagaagcggggccaggtggacaattactgcagacacaactacggggttggtgagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacctgccaagtggagcacccaagcgtaacgagccctctcacagtggaatggagtgcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacagaataatgattttcacgtgtgtgtcatgagtatgtgaggtaatgtatatgttaaataccatgatttagtcattccacactataggcatataacaaaacttcatgcttccacataaatatgctatacaatttttacttgtcaattaaaaaagtaatgctaacatttaaaaaggcagtgcataaaaactgagaacagactataacaactgaaacaaacttggcaaaccgatgagaaaccagccagcaagtcaatcagaactcttcaccccatctacaatattttgtatttataactgtaaattagtgtatagtgtttcactccagagacttcaataatatagtgttatcaaaggacttgtacagatttcagagaaagacacatttagaagacggagaatggagtctccattatgttctacctgagagtcagtatgaaatgtcaaatataaaagtacataattcagaggtctatttcaaagtaataatcatttgagcataatttctccactgacagagacgactgttattttattttcaatcaaa

SEQ ID NO: 151246 - DNA, 827 bp, Homo sapiens
  Payload ID: 9778
  Gene Symbol: HLA-DRB3
  Gene Name: major histocompatibility complex, class II, DR beta 3
  ENST ID: ENST00000611013
  CDS Start-End: 15-815
tcctgttctccagcatggtgtgtctgaggctccctggaggctcctgcatggcagttctgacagtgacactgatggtgctgagctccccactggctttggctggggacaccagaccacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacctcctggagcagaagcggggccaggtggacaattactgcagacacaactacggggttggtgagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacctgccaagtggagcacccaagcgtaacgagccctctcacagtggaatggagtgcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgac

SEQ ID NO: 151247 - DNA, 801 bp, Homo sapiens
  Payload ID: 9778
  Gene Symbol: HLA-DRB3
  Gene Name: major histocompatibility complex, class II, DR beta 3
  ENST ID: ENST00000614901
  CDS Start-End: 1-801
atggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacctgccaagtggagcacccaagcgtaacgagccctctcacagtggaatggagtgcacggtctgaatctgcacagagcaagatgctgagtggagtcgggggctttgtgctgggcctgctcttccttggggccgggctgttcatctacttcaggaatcagaaaggacactctggacttcagccaacaggattcctgagctga

SEQ ID NO: 151248 - DNA, 801 bp, Homo sapiens
  Payload ID: 9778
  Gene Symbol: HLA-DRB3
  Gene Name: major histocompatibility complex, class II, DR beta 3
  ENST ID: ENST00000618225
  CDS Start-End: 1-801
atggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacttgccaagtggagcacccaagcgtaacgagcgctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctga

SEQ ID NO: 151249 - DNA, 801 bp, Homo sapiens
  Payload ID: 9778
  Gene Symbol: HLA-DRB3
  Gene Name: major histocompatibility complex, class II, DR beta 3
  ENST ID: ENST00000613743
  CDS Start-End: 1-801
atggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggtacctggacagatacttccataaccaggaggagaacgtgcgcttcgacagcgacgtgggggagtaccgggcggtgagggagctggggcggcctgatgccgagtactggaacagccagaaggacctcctggagcagaagcggggccaggtggacaattactgcagacacaactacggggttggtgagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacctgccaagtggagcacccaagcgtaacgagccctctcacagtggaatggagtgcacggtctgaatctgcacagagcaagatgctgagtggagtcgggggctttgtgctgggcctgctcttccttggggccgggctgttcatctacttcaggaatcagaaaggacactctggacttcagccaacaggattcctgagctga

SEQ ID NO: 151250 - DNA, 827 bp, Homo sapiens
  Payload ID: 9778
  Gene Symbol: HLA-DRB3
  Gene Name: major histocompatibility complex, class II, DR beta 3
  ENST ID: ENST00000616879
  CDS Start-End: 15-815
tcctgttctccagcatggtgtgtctgaggctccctggaggctcctgcatggcagttctgacagtgacactgatggtgctgagctccccactggctttggctggggacaccagaccacgtttcttggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacttgccaagtggagcacccaagcgtaacgagcgctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgac

SEQ ID NO: 151251 - DNA, 1172 bp, Homo sapiens
  Payload ID: 9779
  Gene Symbol: HLA-DRB4
  Gene Name: major histocompatibility complex, class II, DR beta 4
  ENST ID: ENST00000411959
  CDS Start-End: 64-864
atagttctccctgagtgagacttgcctgctgctctgaccactggtcttgtcctcttctccagcatggtgtgtctgaagctccctggaggctcctgtatggcagcgctgacagtgacattgacggtgctgagctccccactggctttggctggggacacccaaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgagtccaacctaaggtgactgtgtatccttcaaagacccagcccctgcagcaccacaacctcctggtctgctctgtgaatggtttctatccaggcagcattgaagtcaggtggttccggaacagccaggaagagaaggctggggtggtgtccacaggcctgatccagaatggagactggaccttccagaccctggtgatgctggaaacagttcctcggagtggagaggtttacacctgccaagtggagcatccaagcatgatgagccctctcacggtgcaatggagtgcacggtctgaatctgcacagagcaagatgctgagtggagtcgggggctttgtgctgggcctgctcttccttgggacagggctgttcatctacttcaggaatcagaaaggacactctggacttcagccaacaggactcttgagctgaagtgcagatgaccacattcaaggaagaaccttctgccccagctttgcaagatgaaaagctttcccacttggctcttattcttccacaagagctttgtcaggaccaggttgttactggttcagcaactctgcagaaaatgtcctcccttgtggcttccttagctcctgttcttggcctgaagcctcacagctttgatggcagtgcctcatcttcaacttttgtgcttccctttacctaaactgtcctgcctcccatgcatctgtaccccccttgtgccacacattgcattattaaatgtttctcaaaca

SEQ ID NO: 151252 - DNA, 1184 bp, Homo sapiens; identical to SEQ ID NO: 141161
  Payload ID: 9779
  Gene Symbol: HLA-DRB4
  Gene Name: major histocompatibility complex, class II, DR beta 4
  Uniprot ID: P13762
  ENST ID: ENST00000411565
  CDS Start-End: 64-864

SEQ ID NO: 151253 - DNA, 1105 bp, Homo sapiens
  Payload ID: 9779
  Gene Symbol: HLA-DRB4
  Gene Name: major histocompatibility complex, class II, DR beta 4
  ENST ID: ENST00000618380
  CDS Start-End: 36-827
ctcctctggcccctggtcctgtcctgttctccagcatggtgtgtctgaagctccctggaggctcctgcatggcagctctgacagtgacactgatggtgctgagctccccactggctttggctggggacacccaaccacgtttcttggagcaggctaagtctgagtgtcatttcttcaatgggacggagcggtacctgagatatttctataaccaagaggagtacgtgcgcttcaacagcgacatgggggagttccgggcggtgacggagctggggcggcctgacgctgagtactggaacagccagaaggacctcctggagcggaggcgggccgaggtggacacctactgcagatacaactacggggttgtggagagcttcacagtgcagcggcgagtccaacctaaggtgactgtgtatccttcaaagacccagcccctgcagcaccacaacctcctggtctgctctgtgaatggtttctatccaggcagcattgaagtcaggtggttccggaacagccaggaagagaaggctggggtggtgtccacaggcctgatccagaatggagactggaccttccagaccctggtgatgctggaaacagttcctcggagtggagaggtttacacctgccaagtggagcatccaagcatgatgagccctctcacggtgcaatggagtgcacggtctgaatctgcacagagcaagatgctgagtggagtcgggggctttgtgctgggcctgctcttccttgggacagggctgttcatctacttcaggaatcagaaaggacactctggacttcagccaacaggactcttgagctgaagtgcagatgaccacattcaaggaagaaccttctgccccagctttgcaagatgaaaagctttcccacttggctcttattcttccacaagagctttgtcaggaccaggttgttactggttcagcaactctgcagaaaatgtcctcccttgtggcttccttagctcctgttcttggcctgaagcctcacagctttgatggcagtgcctcatcttcaacttttgtgcttccctttacctaaactgtcctgcctcccatgcatctgtaccccccttgtgcca

SEQ ID NO: 151254 - DNA, 920 bp, Homo sapiens
  Payload ID: 9779
  Gene Symbol: HLA-DRB4
  Gene Name: major histocompatibility complex, class II, DR beta 4
  ENST ID: ENST00000615644
  CDS Start-End: 64-864
atagttctccctgagtgagactcacctgctcctctggcccctggtcctgtcctgttctccagcatggtgtgtctgaagctccctggaggctcctgcatggcagctctgacagtgacactgatggtgctgagctccccactggctttggctggggacacccaaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctggggcggcctgacgctgagtactggaacagccagaaggacctcctggagcggaggcgggccgaggtggacacctactgcagatacaactacggggttgtggagagcttcacagtgcagcggcgaggtgagcctaaggtgactgtgtatccttcaaagacccagcccctgcagcaccacaacctcctggtctgctctgtgaatggtttctatccaggcagcattgaagtcaggtggttccggaacagccaggaagagaaggctggggtggtgtccacaggcctgatccagaatggagactggaccttccagaccctggtgatgctggaaacagttcctcggagtggagaggtttacacctgccaagtggagcatccaagcatgatgagccctctcacggtgcaatggagtgcacggtctgaatctgcacagagcaagatgctgagtggagtcgggggctttgtgctgggcctgctcttccttgggacagggctgttcatctacttcaggaatcagaaaggacactctggacttcagccaacaggactcttgagctgaagtgcagatgaccacattcaaggaagaaccttctgccccagctttgcaagatgaaa

SEQ ID NO: 151255 - DNA, 1260 bp, Homo sapiens
  Payload ID: 9780
  Gene Symbol: HLA-DRB5
  Gene Name: major histocompatibility complex, class II, DR beta 5
  Uniprot ID: Q30154
  ENST ID: ENST00000374975
  CDS Start-End: 64-864
atagttctccctgagtgagacttgcctgctcctctggcccctggtcctgtcctgttctccagcatggtgtgtctgaagctccctggaggttcctacatggcaaagctgacagtgacactgatggtgctgagctccccactggctttggctggggacacccgaccacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcggcgagttgagcctaaggtgactgtgtatcctgcaaggacccagaccctgcagcaccacaacctcctggtctgctctgtgaatggtttctatccaggcagcattgaagtcaggtggttccggaacagccaggaagagaaggctggggtggtgtccacaggcctgattcagaatggagactggaccttccagaccctggtgatgctggaaacagttcctcgaagtggagaggtttacacctgccaagtggagcacccaagcgtgacgagccctctcacagtggaatggagagcacagtctgaatctgcacagagcaagatgctgagtggagtcgggggctttgtgctgggcctgctcttccttggggccgggctattcatctacttcaagaatcagaaagggcactctggacttcacccaacaggactcgtgagctgaagtgcagatgaccacattcaagggggaaccttctgccccagctttgcatgatgaaaagctttcctgcttggctcttattcttccacaagagaggactttctcaggccctggttgctaccggttcagcaactctgcagaaaatgtccatccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccacctggctccaaagacaaaaaataaaaagaaaagaaaaagggaagattatttcctaata

SEQ ID NO: 151256 - DNA, 2043 bp, Homo sapiens
  Payload ID: 9781
  Gene Symbol: MR1
  Gene Name: major histocompatibility complex, class I-related
  Uniprot ID: Q95460
  ENST ID: ENST00000282990
  CDS Start-End: 6-755
ggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatgacacaacgcttccctacattctatttgtcaatgatgatttgcaactagttggagattctcagagcaggaaggaatcttttcaaccagagcaggaactgtcttctgcaatgccttggacttgagcctccagcctccacttgaacaccatgtgaagggaacctcagtacttcataaaatggcctttctcattcatctttcatgggaacatttattgtacaagcgctttgaatatcatgggcaccatgactgtgaccctacaggtaggattggatcactccatgagagtagccggcaggtttctacaatggcctgggaatggactgattatttttatacattttctggcctgagagaaagccaaagtcccctgctgttcacagcaaccctgcctgggagcttggaatcttggtaatctgcccggttggatctatggaggtagtctcaccctttttgtcttttgtgggaaattaagagaaataattatcagacatatcatcacctccagtggaactacagagacctggacccagctgcactattttaatgtaaaaataacagtatggccaggtgcagtggctcacgcctgtaatcccatcactttgagcagccaaggcgggcggatcacgaggtcaggagattaagaccatcctggccaatatggtgaaaccctgtctctactaaaatacaaaaaattagctgggcatggtgttgcgtgcctgtagtcccagctacttgggaggctgagacaggggaattgcttgaacccgggaggcagagattgcagtgagccgagatcacgccactgcactccagcctggcgacagagtgagactctatctcaaaataataataataataataataataataataataataataacagtatatttggtgtcaggagagggctcaattctcatttctgcctttcctgtgctggctcatggtagctgggcatgacttgccttcctacataggttgtcttcatacatatgcactgggaatcaataaaagcccatggtgagaatgaa

SEQ ID NO: 151257 - DNA, 1154 bp, Homo sapiens
  Payload ID: 9781
  Gene Symbol: MR1
  Gene Name: major histocompatibility complex, class I-related
  Uniprot ID: Q95460
  ENST ID: ENST00000367579
  CDS Start-End: 6-896
ggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagagcccccactggtcagagtaaatcgcaaagaaacttttccaggggttacagctctcttctgcaaagctcatggcttttaccccccagaaatttacatgacatggatgaaaaacggggaagaaattgtccaagaaattgattatggagacattcttcccagtggggatggaacctatcaggcgtgggcatcaattgagcttgatcctcagagcagcaacctttactcctgtcatgtggagcactgcggtgtccacatggttcttcaggtcccccaggaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatga

SEQ ID NO: 151258 - DNA, 7704 bp, Homo sapiens
  Payload ID: 9781
  Gene Symbol: MR1
  Gene Name: major histocompatibility complex, class I-related
  Uniprot ID: Q95460
  ENST ID: ENST00000367580
  CDS Start-End: 6-1031
ggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagagcccccactggtcagagtaaatcgcaaagaaacttttccaggggttacagctctcttctgcaaagctcatggcttttaccccccagaaatttacatgacatggatgaaaaacggggaagaaattgtccaagaaattgattatggagacattcttcccagtggggatggaacctatcaggcgtgggcatcaattgagcttgatcctcagagcagcaacctttactcctgtcatgtggagcactgcggtgtccacatggttcttcaggtcccccaggaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatgacacaacgcttccctacattctatttgtcaatgatgatttgcaactagttggagattctcagagcaggaaggaatcttttcaaccagagcaggaactgtcttctgcaatgccttggacttgagcctccagcctccacttgaacaccatgtgaagggaacctcagtacttcataaaatggcctttctcattcatctttcatgggaacatttattgtacaagcgctttgaatatcatgggcaccatgactgtgaccctacaggtaggattggatcactccatgagagtagccggcaggtttctacaatggcctgggaatggactgattatttttatacattttctggcctgagagaaagccaaagtcccctgctgttcacagcaaccctgcctgggagcttggaatcttggtaatctgcccggttggatctatggaggtagtctcaccctttttgtcttttgtgggaaattaagagaaataattatcagacatatcatcacctccagtggaactacagagacctggacccagctgcactattttaatgtaaaaataacagtatggccaggtgcagtggctcacgcctgtaatcccatcactttgagcagccaaggcgggcggatcacgaggtcaggagattaagaccatcctggccaatatggtgaaaccctgtctctactaaaatacaaaaaattagctgggcatggtgttgcgtgcctgtagtcccagctacttgggaggctgagacaggggaattgcttgaacccgggaggcagagattgcagtgagccgagatcacgccactgcactccagcctggcgacagagtgagactctatctcaaaataataataataataataataataataataataataataacagtatatttggtgtcaggagagggctcaattctcatttctgcctttcctgtgctggctcatggtagctgggcatgacttgccttcctacataggttgtcttcatacatatgcactgggaatcaataaaagcccatggtgagaatgaacatccccttaatgttccttactatccccaacccctgaggcctcacctactgccctgccatgtggagctacttgccctggggctgccagtcacacattcctcggtcctacttctctgaccccgtttgactctgcacctgagccctaatgcttacttcagtgacctgaactttgacaagtggcttttgtcctgcacctcaggtttgacctctgctctcccttgaccttgactgtgacatttgacctttggctttaatcattacagcctcagataaaggtaccttcagcccgggcacagtggctcacgcctgtaatcctagcactttgggaggctgaggcaggcggattccctgagctcaggagttcaagaccagcctgggcaacacggtgaaaccctgtctctactaaaatacaaataattagctgggcatggtggcatgtgcctatagtcccagctacttgggaggctaaggcaggagaatcacttgaatctataaggcagaggtggcagtgagccgagatcacaccactgcactccagcctgggcaacggagcaagactctgtctccaaaaaaaaaaagaaagataccctcagtgtgccaggcctctaagagctcacctgccaggcttcctccttgctccactgtcccatgtaattccatatatgaagctaccactgtacatctctcttttccggtgcctgttgagttgcatagaagcacagttgtgtttattttgtttttagggttgccatgggcaatttccgtgccacttttaagcagtgttgcactgtgaagagaatgtaggcaagtttatttctggaatggtttcttcttacaatcagaatagttaggatgtaatatatttttgggtgggcatttaaagtgaaaaggtacatatttacatagacacaggtgataatgtatctatgtaaatgccttttgattctgcaactgcaggatactctcatcaaagacacagataaaaagcctctgtgtttccaaggccttgccctacacctaacacataatatgtccaaatggatgaagaggaggcaaggacaaggatgtgatgacaaaacattctgttatgcacttgtagcatttatgtttcttcctgggggattttataatactaaaagaatcataatataaagagatgattaaaaaaaaaatactgccgggcacggtggctcatgcctgtaatcccagcattttgggaggccgaggtgggcagatcacctgaggtcgggagttcgagaccagcctgaccaacatggagaaaccctgtctctaccaaacatacaaaattagccggggatggtggcgcatgcctataatcccagctactcgggagtctgaggcagaagaaccgcttgaacccgggaggcagaggttgtggtgagccgagatcgcgccatcgcactctagcctgggcaacaagagtgaaactccatctcaaaaaaataaaaataaaataagtaagtaatacctaaaattctgcaaccttcattttactatagatggttgaagattatattacttcttaattgttttagccttgttattgcttcattacttcatggttgttgagtacagatgctcagtaatcataacctatgaaatatttgacaccatgatctaaacattaaaaacaaataactgtgctattgccacagctatgttttggctttgaattttctttactgaatattttggatcaagaacactagatgagaaacctgttcaactctgttcttttttttttttttaactccactgtatttattacctgtttttgttttttttgtttgtttgtttttgatgtgcatatagaccaagatgtggtaaatttaaatggcagatgtttttgatgtggtacatttaagggagagaaagcagtttaaagagcagggtgaaaaatccaacaagactccatcgagagtttctgagctctcccatcaggggccagtcctcctttcctctctcctcttactcccatgatttccaagttgtgatcctttccttatttctgaggaatgacttggtttctcctcttctttttttggcctgagagaagatgtttttgcacttgtagctatgaggaacagattgtccactagggaggccagctgatcattttctgccagagtcacacagagcagtcacaccttattttgaaaaccactgtctggggtctttgtcctcacatatgcaggtctagtgtccccacaaagtgatcagatggatatataaagtggagtgccaatgtattaatttactgtgagaaacacaattgctaagtgggtcagatatctgtctcagctggtcagtacaccttccagcaggaaaatctacataagaacaactaaatcacaatctgtagagtgcttgatgaccccagaattggtgcaaggggacacattcttgcttgttagcacctgctctctggagtttgctattttctcacacacagtgtattagttcacagaatgttctccaaggaggacagggggctttgcccatagccatgtgctgtgggcagcagagctaggaagaagcacaggcatctcccagcccaggtgtttcccacttaactgcattgcccttttcatcttttttttttccccaatagcttcaggacattcagtacattgtgctttttagaggttgatgattccactgcctgagctgccttcacctctctttctttggaaattgccatctttgagcattgtatgtctctgtaacatctctgcatctccttttcactctggcctccctttctccattgtccttctagcttctggttgccccaaaccccacagactgtgtaacaaaacccaaaacctattggtttaaaacaatacccattttattttctttcatagtttctatgggtcaggaatttggatatggcttgggtaagcagttctggcttctcatggagttggaggcaagtggtggctggaacagaaatggggcagccaggggtggtggccaggcatcagctacatctcctccatgtagtctcaggaactctccatgtaatctctctgtgtgggttgggcttcctcacaacatggtggcctcagggcagtcactgcttacatggcagctagcttccctcagagtgagtatcccaagagatcacagtcaaagtgcatagcatttatataatctaatcttggaagtcacaaaatgtcattcttgtgatactctcattggtgaagaagtcataaaatcctgctcaggttcaaaaagagggtgtatagaacccaacactcaataggaagattgtcagagttacattgtaagaagagcatgtagttgggagatatcattgtggccattttgggaaagatgcaacatgtcacaatgtcatgttctccatcgtctccccgttccaccttgtactggtttccaagggtagtcgtttaaaagtaccacaaaaactgggtggcttggaacaacagaaatttattgtttcacagttctggaggccagaagttcaaaatgaagtgttggcagaaacatgctgcctctaaagggactgggaaaggatctgttccaggcttccctcctatcttctggttgttccttgccttctggctgcgtaactctagtcttcatttggtgttctccctgcatgcatggctttgtgtccaaatttccttttttcatgaggccatcagtcatactggattagggacccactctactactgcaggatgacctcaccttcccaaattacatctgcaacaaccctatttccaaagaaggccacattctgaggtactgggggttataacttcaacatgaattttttggaggaaacaattcaactcctaacacatctctacccaacctctgtaggttccctcaatccaccaaaattttttggctccactggattatctagcagttaggaaaccaagatcattaaatgaattcaccgcaactacagtgagactgactaccttagcttacctctgtgaaaggagttaagccaaaggaatctgtggaattttggagagtttgggagcatttgggggcaggaggcaaatgttcttcctttaaatcacaacacttagttctcttccatttataagactcacccctccatcccaacccctgcaccacaggacaaggaagtgttcttggtcttcaactttcatccctgatggtgaaagcagttgctcctgacctatttgcccaccagcttctcctctggagcctgaggcttctgatgcctgcctggctggttctcagtaagaaggtcaagttcaaccagaggggagatgctgatgcctttcagtacttaaatatgagttcagaccctggggcctggacataagatttggggtcccctggatataagatttctgaaaacactcagactgtggagacccctgctgagggagaagccccaaactgtggcttcaggggaatgcaccaaggctctcattgaggccaccttctccaacaagctcccctcctgcttccccatggctggcatggctgaggaaaaaggacactgagcacagcccgtgcatgagcggcttgccatgcaacaggataaaacccataatgccactcagcaagccttggttgtaaatctagtttgattacatttgtaatcaaatgatggccatttgttctgtttctggtttgtgaaccaactgaagacataagcagggcctcagctaacccacaaatagcacatgtgtgcaaactggaaaaatgaacccttcttctgggaggacgccagcccaggccaggtcacccggcttggccagcagaacacagagtagattttggtcccgtttgttccccagtggggtatctatccttgtgcagggcacaagcctacatggtggctctggtcatatcattagaaaatagacagaaatgggctgcacaccagaatgaatgaattgaattgaaagggaggagtgatggtggaaaaaaaaacaagtcaattcatttagactggtagaaccagaaccactgtgtagtacatccaaacggttaaaattccctggaagatgttacataatcctatcatggtgtttatttatggaaatctattttaaaaattttatgtaatactgcacagtctgtttgcatgatgccttgtacgtagtagcaactcagtaaatactttttgaatgaactagtatagtattttaattagctagtcttcatgtactggtacaaaagaacagtgtcatcttacagctgaagtcatagaggggaaatatcccactcaagatcatataacattccaggtactcaggatgaatggtttgaggactggtctgaattcttcaaaggtttcagctgtattaacattctccatctaataaactttatcttgtcattgca

SEQ ID NO: 151259 - DNA, 7479 bp, Homo sapiens
  Payload ID: 9781
  Gene Symbol: MR1
  Gene Name: major histocompatibility complex, class I-related
  Uniprot ID: Q95460
  ENST ID: ENST00000434571
  CDS Start-End: 162-806
agaatcttctgtaggcctttctcttgccttcttttattcacaactgatgacactgcatatcttcccctgttcttattgggagaaggccttgtgtgtcaccaagaggttctcagaagggacctgtcagtttttggttaaaagaacccggaaagagaaggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatgacacaacgcttccctacattctatttgtcaatgatgatttgcaactagttggagattctcagagcaggaaggaatcttttcaaccagagcaggaactgtcttctgcaatgccttggacttgagcctccagcctccacttgaacaccatgtgaagggaacctcagtacttcataaaatggcctttctcattcatctttcatgggaacatttattgtacaagcgctttgaatatcatgggcaccatgactgtgaccctacaggtaggattggatcactccatgagagtagccggcaggtttctacaatggcctgggaatggactgattatttttatacattttctggcctgagagaaagccaaagtcccctgctgttcacagcaaccctgcctgggagcttggaatcttggtaatctgcccggttggatctatggaggtagtctcaccctttttgtcttttgtgggaaattaagagaaataattatcagacatatcatcacctccagtggaactacagagacctggacccagctgcactattttaatgtaaaaataacagtatggccaggtgcagtggctcacgcctgtaatcccatcactttgagcagccaaggcgggcggatcacgaggtcaggagattaagaccatcctggccaatatggtgaaaccctgtctctactaaaatacaaaaaattagctgggcatggtgttgcgtgcctgtagtcccagctacttgggaggctgagacaggggaattgcttgaacccgggaggcagagattgcagtgagccgagatcacgccactgcactccagcctggcgacagagtgagactctatctcaaaataataataataataataataataataataataataataacagtatatttggtgtcaggagagggctcaattctcatttctgcctttcctgtgctggctcatggtagctgggcatgacttgccttcctacataggttgtcttcatacatatgcactgggaatcaataaaagcccatggtgagaatgaacatccccttaatgttccttactatccccaacccctgaggcctcacctactgccctgccatgtggagctacttgccctggggctgccagtcacacattcctcggtcctacttctctgaccccgtttgactctgcacctgagccctaatgcttacttcagtgacctgaactttgacaagtggcttttgtcctgcacctcaggtttgacctctgctctcccttgaccttgactgtgacatttgacctttggctttaatcattacagcctcagataaaggtaccttcagcccgggcacagtggctcacgcctgtaatcctagcactttgggaggctgaggcaggcggattccctgagctcaggagttcaagaccagcctgggcaacacggtgaaaccctgtctctactaaaatacaaataattagctgggcatggtggcatgtgcctatagtcccagctacttgggaggctaaggcaggagaatcacttgaatctataaggcagaggtggcagtgagccgagatcacaccactgcactccagcctgggcaacggagcaagactctgtctccaaaaaaaaaaagaaagataccctcagtgtgccaggcctctaagagctcacctgccaggcttcctccttgctccactgtcccatgtaattccatatatgaagctaccactgtacatctctcttttccggtgcctgttgagttgcatagaagcacagttgtgtttattttgtttttagggttgccatgggcaatttccgtgccacttttaagcagtgttgcactgtgaagagaatgtaggcaagtttatttctggaatggtttcttcttacaatcagaatagttaggatgtaatatatttttgggtgggcatttaaagtgaaaaggtacatatttacatagacacaggtgataatgtatctatgtaaatgccttttgattctgcaactgcaggatactctcatcaaagacacagataaaaagcctctgtgtttccaaggccttgccctacacctaacacataatatgtccaaatggatgaagaggaggcaaggacaaggatgtgatgacaaaacattctgttatgcacttgtagcatttatgtttcttcctgggggattttataatactaaaagaatcataatataaagagatgattaaaaaaaaaatactgccgggcacggtggctcatgcctgtaatcccagcattttgggaggccgaggtgggcagatcacctgaggtcgggagttcgagaccagcctgaccaacatggagaaaccctgtctctaccaaacatacaaaattagccggggatggtggcgcatgcctataatcccagctactcgggagtctgaggcagaagaaccgcttgaacccgggaggcagaggttgtggtgagccgagatcgcgccatcgcactctagcctgggcaacaagagtgaaactccatctcaaaaaaataaaaataaaataagtaagtaatacctaaaattctgcaaccttcattttactatagatggttgaagattatattacttcttaattgttttagccttgttattgcttcattacttcatggttgttgagtacagatgctcagtaatcataacctatgaaatatttgacaccatgatctaaacattaaaaacaaataactgtgctattgccacagctatgttttggctttgaattttctttactgaatattttggatcaagaacactagatgagaaacctgttcaactctgttcttttttttttttttaactccactgtatttattacctgtttttgttttttttgtttgtttgtttttgatgtgcatatagaccaagatgtggtaaatttaaatggcagatgtttttgatgtggtacatttaagggagagaaagcagtttaaagagcagggtgaaaaatccaacaagactccatcgagagtttctgagctctcccatcaggggccagtcctcctttcctctctcctcttactcccatgatttccaagttgtgatcctttccttatttctgaggaatgacttggtttctcctcttctttttttggcctgagagaagatgtttttgcacttgtagctatgaggaacagattgtccactagggaggccagctgatcattttctgccagagtcacacagagcagtcacaccttattttgaaaaccactgtctggggtctttgtcctcacatatgcaggtctagtgtccccacaaagtgatcagatggatatataaagtggagtgccaatgtattaatttactgtgagaaacacaattgctaagtgggtcagatatctgtctcagctggtcagtacaccttccagcaggaaaatctacataagaacaactaaatcacaatctgtagagtgcttgatgaccccagaattggtgcaaggggacacattcttgcttgttagcacctgctctctggagtttgctattttctcacacacagtgtattagttcacagaatgttctccaaggaggacagggggctttgcccatagccatgtgctgtgggcagcagagctaggaagaagcacaggcatctcccagcccaggtgtttcccacttaactgcattgcccttttcatcttttttttttccccaatagcttcaggacattcagtacattgtgctttttagaggttgatgattccactgcctgagctgccttcacctctctttctttggaaattgccatctttgagcattgtatgtctctgtaacatctctgcatctccttttcactctggcctccctttctccattgtccttctagcttctggttgccccaaaccccacagactgtgtaacaaaacccaaaacctattggtttaaaacaatacccattttattttctttcatagtttctatgggtcaggaatttggatatggcttgggtaagcagttctggcttctcatggagttggaggcaagtggtggctggaacagaaatggggcagccaggggtggtggccaggcatcagctacatctcctccatgtagtctcaggaactctccatgtaatctctctgtgtgggttgggcttcctcacaacatggtggcctcagggcagtcactgcttacatggcagctagcttccctcagagtgagtatcccaagagatcacagtcaaagtgcatagcatttatataatctaatcttggaagtcacaaaatgtcattcttgtgatactctcattggtgaagaagtcataaaatcctgctcaggttcaaaaagagggtgtatagaacccaacactcaataggaagattgtcagagttacattgtaagaagagcatgtagttgggagatatcattgtggccattttgggaaagatgcaacatgtcacaatgtcatgttctccatcgtctccccgttccaccttgtactggtttccaagggtagtcgtttaaaagtaccacaaaaactgggtggcttggaacaacagaaatttattgtttcacagttctggaggccagaagttcaaaatgaagtgttggcagaaacatgctgcctctaaagggactgggaaaggatctgttccaggcttccctcctatcttctggttgttccttgccttctggctgcgtaactctagtcttcatttggtgttctccctgcatgcatggctttgtgtccaaatttccttttttcatgaggccatcagtcatactggattagggacccactctactactgcaggatgacctcaccttcccaaattacatctgcaacaaccctatttccaaagaaggccacattctgaggtactgggggttataacttcaacatgaattttttggaggaaacaattcaactcctaacacatctctacccaacctctgtaggttccctcaatccaccaaaattttttggctccactggattatctagcagttaggaaaccaagatcattaaatgaattcaccgcaactacagtgagactgactaccttagcttacctctgtgaaaggagttaagccaaaggaatctgtggaattttggagagtttgggagcatttgggggcaggaggcaaatgttcttcctttaaatcacaacacttagttctcttccatttataagactcacccctccatcccaacccctgcaccacaggacaaggaagtgttcttggtcttcaactttcatccctgatggtgaaagcagttgctcctgacctatttgcccaccagcttctcctctggagcctgaggcttctgatgcctgcctggctggttctcagtaagaaggtcaagttcaaccagaggggagatgctgatgcctttcagtacttaaatatgagttcagaccctggggcctggacataagatttggggtcccctggatataagatttctgaaaacactcagactgtggagacccctgctgagggagaagccccaaactgtggcttcaggggaatgcaccaaggctctcattgaggccaccttctccaacaagctcccctcctgcttccccatggctggcatggctgaggaaaaaggacactgagcacagcccgtgcatgagcggcttgccatgcaacaggataaaacccataatgccactcagcaagccttggttgtaaatctagtttgattacatttgtaatcaaatgatggccatttgttctgtttctggtttgtgaaccaactgaagacataagcagggcctcagctaacccacaaatagcacatgtgtgcaaactggaaaaatgaacccttcttctgggaggacgccagcccaggccaggtcacccggcttggccagcagaacacagagtagattttggtcccgtttgttccccagtggggtatctatccttgtgcagggcacaagcctacatggtggctctggtcatatcattagaaaatagacagaaatgggctgcacaccagaatgaatgaattgaattgaaagggaggagtgatggtggaaaaaaaaacaagtcaattcatttagactggtagaaccagaaccactgtgtagtacatccaaacggttaaaattccctggaagatgttacataatcctatcatggtgtttatttatggaaatctattttaaaaattttatgtaatactgcacagtctgtttgcatgatgccttgtacgtagtagcaactcagtaaatactttttgaatgaactagtatagtattttaattagctagtcttcatgtactggtacaaaagaacagtgtcatcttacagctgaagtcatagaggggaaatatcccactcaagatcatataacattccaggtactcaggatgaatggtttgaggactggtctgaattcttcaaaggtttcagctgtattaacattctccatctaataaactttatcttgtcattgca

SEQ ID NO: 151260 - DNA, 7860 bp, Homo sapiens
  Payload ID: 9781
  Gene Symbol: MR1
  Gene Name: major histocompatibility complex, class I-related
  Uniprot ID: Q95460
  ENST ID: ENST00000614012
  CDS Start-End: 162-1187
agaatcttctgtaggcctttctcttgccttcttttattcacaactgatgacactgcatatcttcccctgttcttattgggagaaggccttgtgtgtcaccaagaggttctcagaagggacctgtcagtttttggttaaaagaacccggaaagagaaggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagagcccccactggtcagagtaaatcgcaaagaaacttttccaggggttacagctctcttctgcaaagctcatggcttttaccccccagaaatttacatgacatggatgaaaaacggggaagaaattgtccaagaaattgattatggagacattcttcccagtggggatggaacctatcaggcgtgggcatcaattgagcttgatcctcagagcagcaacctttactcctgtcatgtggagcactgcggtgtccacatggttcttcaggtcccccaggaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatgacacaacgcttccctacattctatttgtcaatgatgatttgcaactagttggagattctcagagcaggaaggaatcttttcaaccagagcaggaactgtcttctgcaatgccttggacttgagcctccagcctccacttgaacaccatgtgaagggaacctcagtacttcataaaatggcctttctcattcatctttcatgggaacatttattgtacaagcgctttgaatatcatgggcaccatgactgtgaccctacaggtaggattggatcactccatgagagtagccggcaggtttctacaatggcctgggaatggactgattatttttatacattttctggcctgagagaaagccaaagtcccctgctgttcacagcaaccctgcctgggagcttggaatcttggtaatctgcccggttggatctatggaggtagtctcaccctttttgtcttttgtgggaaattaagagaaataattatcagacatatcatcacctccagtggaactacagagacctggacccagctgcactattttaatgtaaaaataacagtatggccaggtgcagtggctcacgcctgtaatcccatcactttgagcagccaaggcgggcggatcacgaggtcaggagattaagaccatcctggccaatatggtgaaaccctgtctctactaaaatacaaaaaattagctgggcatggtgttgcgtgcctgtagtcccagctacttgggaggctgagacaggggaattgcttgaacccgggaggcagagattgcagtgagccgagatcacgccactgcactccagcctggcgacagagtgagactctatctcaaaataataataataataataataataataataataataataacagtatatttggtgtcaggagagggctcaattctcatttctgcctttcctgtgctggctcatggtagctgggcatgacttgccttcctacataggttgtcttcatacatatgcactgggaatcaataaaagcccatggtgagaatgaacatccccttaatgttccttactatccccaacccctgaggcctcacctactgccctgccatgtggagctacttgccctggggctgccagtcacacattcctcggtcctacttctctgaccccgtttgactctgcacctgagccctaatgcttacttcagtgacctgaactttgacaagtggcttttgtcctgcacctcaggtttgacctctgctctcccttgaccttgactgtgacatttgacctttggctttaatcattacagcctcagataaaggtaccttcagcccgggcacagtggctcacgcctgtaatcctagcactttgggaggctgaggcaggcggattccctgagctcaggagttcaagaccagcctgggcaacacggtgaaaccctgtctctactaaaatacaaataattagctgggcatggtggcatgtgcctatagtcccagctacttgggaggctaaggcaggagaatcacttgaatctataaggcagaggtggcagtgagccgagatcacaccactgcactccagcctgggcaacggagcaagactctgtctccaaaaaaaaaaagaaagataccctcagtgtgccaggcctctaagagctcacctgccaggcttcctccttgctccactgtcccatgtaattccatatatgaagctaccactgtacatctctcttttccggtgcctgttgagttgcatagaagcacagttgtgtttattttgtttttagggttgccatgggcaatttccgtgccacttttaagcagtgttgcactgtgaagagaatgtaggcaagtttatttctggaatggtttcttcttacaatcagaatagttaggatgtaatatatttttgggtgggcatttaaagtgaaaaggtacatatttacatagacacaggtgataatgtatctatgtaaatgccttttgattctgcaactgcaggatactctcatcaaagacacagataaaaagcctctgtgtttccaaggccttgccctacacctaacacataatatgtccaaatggatgaagaggaggcaaggacaaggatgtgatgacaaaacattctgttatgcacttgtagcatttatgtttcttcctgggggattttataatactaaaagaatcataatataaagagatgattaaaaaaaaaatactgccgggcacggtggctcatgcctgtaatcccagcattttgggaggccgaggtgggcagatcacctgaggtcgggagttcgagaccagcctgaccaacatggagaaaccctgtctctaccaaacatacaaaattagccggggatggtggcgcatgcctataatcccagctactcgggagtctgaggcagaagaaccgcttgaacccgggaggcagaggttgtggtgagccgagatcgcgccatcgcactctagcctgggcaacaagagtgaaactccatctcaaaaaaataaaaataaaataagtaagtaatacctaaaattctgcaaccttcattttactatagatggttgaagattatattacttcttaattgttttagccttgttattgcttcattacttcatggttgttgagtacagatgctcagtaatcataacctatgaaatatttgacaccatgatctaaacattaaaaacaaataactgtgctattgccacagctatgttttggctttgaattttctttactgaatattttggatcaagaacactagatgagaaacctgttcaactctgttcttttttttttttttaactccactgtatttattacctgtttttgttttttttgtttgtttgtttttgatgtgcatatagaccaagatgtggtaaatttaaatggcagatgtttttgatgtggtacatttaagggagagaaagcagtttaaagagcagggtgaaaaatccaacaagactccatcgagagtttctgagctctcccatcaggggccagtcctcctttcctctctcctcttactcccatgatttccaagttgtgatcctttccttatttctgaggaatgacttggtttctcctcttctttttttggcctgagagaagatgtttttgcacttgtagctatgaggaacagattgtccactagggaggccagctgatcattttctgccagagtcacacagagcagtcacaccttattttgaaaaccactgtctggggtctttgtcctcacatatgcaggtctagtgtccccacaaagtgatcagatggatatataaagtggagtgccaatgtattaatttactgtgagaaacacaattgctaagtgggtcagatatctgtctcagctggtcagtacaccttccagcaggaaaatctacataagaacaactaaatcacaatctgtagagtgcttgatgaccccagaattggtgcaaggggacacattcttgcttgttagcacctgctctctggagtttgctattttctcacacacagtgtattagttcacagaatgttctccaaggaggacagggggctttgcccatagccatgtgctgtgggcagcagagctaggaagaagcacaggcatctcccagcccaggtgtttcccacttaactgcattgcccttttcatcttttttttttccccaatagcttcaggacattcagtacattgtgctttttagaggttgatgattccactgcctgagctgccttcacctctctttctttggaaattgccatctttgagcattgtatgtctctgtaacatctctgcatctccttttcactctggcctccctttctccattgtccttctagcttctggttgccccaaaccccacagactgtgtaacaaaacccaaaacctattggtttaaaacaatacccattttattttctttcatagtttctatgggtcaggaatttggatatggcttgggtaagcagttctggcttctcatggagttggaggcaagtggtggctggaacagaaatggggcagccaggggtggtggccaggcatcagctacatctcctccatgtagtctcaggaactctccatgtaatctctctgtgtgggttgggcttcctcacaacatggtggcctcagggcagtcactgcttacatggcagctagcttccctcagagtgagtatcccaagagatcacagtcaaagtgcatagcatttatataatctaatcttggaagtcacaaaatgtcattcttgtgatactctcattggtgaagaagtcataaaatcctgctcaggttcaaaaagagggtgtatagaacccaacactcaataggaagattgtcagagttacattgtaagaagagcatgtagttgggagatatcattgtggccattttgggaaagatgcaacatgtcacaatgtcatgttctccatcgtctccccgttccaccttgtactggtttccaagggtagtcgtttaaaagtaccacaaaaactgggtggcttggaacaacagaaatttattgtttcacagttctggaggccagaagttcaaaatgaagtgttggcagaaacatgctgcctctaaagggactgggaaaggatctgttccaggcttccctcctatcttctggttgttccttgccttctggctgcgtaactctagtcttcatttggtgttctccctgcatgcatggctttgtgtccaaatttccttttttcatgaggccatcagtcatactggattagggacccactctactactgcaggatgacctcaccttcccaaattacatctgcaacaaccctatttccaaagaaggccacattctgaggtactgggggttataacttcaacatgaattttttggaggaaacaattcaactcctaacacatctctacccaacctctgtaggttccctcaatccaccaaaattttttggctccactggattatctagcagttaggaaaccaagatcattaaatgaattcaccgcaactacagtgagactgactaccttagcttacctctgtgaaaggagttaagccaaaggaatctgtggaattttggagagtttgggagcatttgggggcaggaggcaaatgttcttcctttaaatcacaacacttagttctcttccatttataagactcacccctccatcccaacccctgcaccacaggacaaggaagtgttcttggtcttcaactttcatccctgatggtgaaagcagttgctcctgacctatttgcccaccagcttctcctctggagcctgaggcttctgatgcctgcctggctggttctcagtaagaaggtcaagttcaaccagaggggagatgctgatgcctttcagtacttaaatatgagttcagaccctggggcctggacataagatttggggtcccctggatataagatttctgaaaacactcagactgtggagacccctgctgagggagaagccccaaactgtggcttcaggggaatgcaccaaggctctcattgaggccaccttctccaacaagctcccctcctgcttccccatggctggcatggctgaggaaaaaggacactgagcacagcccgtgcatgagcggcttgccatgcaacaggataaaacccataatgccactcagcaagccttggttgtaaatctagtttgattacatttgtaatcaaatgatggccatttgttctgtttctggtttgtgaaccaactgaagacataagcagggcctcagctaacccacaaatagcacatgtgtgcaaactggaaaaatgaacccttcttctgggaggacgccagcccaggccaggtcacccggcttggccagcagaacacagagtagattttggtcccgtttgttccccagtggggtatctatccttgtgcagggcacaagcctacatggtggctctggtcatatcattagaaaatagacagaaatgggctgcacaccagaatgaatgaattgaattgaaagggaggagtgatggtggaaaaaaaaacaagtcaattcatttagactggtagaaccagaaccactgtgtagtacatccaaacggttaaaattccctggaagatgttacataatcctatcatggtgtttatttatggaaatctattttaaaaattttatgtaatactgcacagtctgtttgcatgatgccttgtacgtagtagcaactcagtaaatactttttgaatgaactagtatagtattttaattagctagtcttcatgtactggtacaaaagaacagtgtcatcttacagctgaagtcatagaggggaaatatcccactcaagatcatataacattccaggtactcaggatgaatggtttgaggactggtctgaattcttcaaaggtttcagctgtattaacattctccatctaataaactttatcttgtcattgca

SEQ ID NO: 151261 - DNA, 7584 bp, Homo sapiens
  Payload ID: 9781
  Gene Symbol: MR1
  Gene Name: major histocompatibility complex, class I-related
  Uniprot ID: Q95460
  ENST ID: ENST00000617803
  CDS Start-End: 162-911
agaatcttctgtaggcctttctcttgccttcttttattcacaactgatgacactgcatatcttcccctgttcttattgggagaaggccttgtgtgtcaccaagaggttctcagaagggacctgtcagtttttggttaaaagaacccggaaagagaaggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatgacacaacgcttccctacattctatttgtcaatgatgatttgcaactagttggagattctcagagcaggaaggaatcttttcaaccagagcaggaactgtcttctgcaatgccttggacttgagcctccagcctccacttgaacaccatgtgaagggaacctcagtacttcataaaatggcctttctcattcatctttcatgggaacatttattgtacaagcgctttgaatatcatgggcaccatgactgtgaccctacaggtaggattggatcactccatgagagtagccggcaggtttctacaatggcctgggaatggactgattatttttatacattttctggcctgagagaaagccaaagtcccctgctgttcacagcaaccctgcctgggagcttggaatcttggtaatctgcccggttggatctatggaggtagtctcaccctttttgtcttttgtgggaaattaagagaaataattatcagacatatcatcacctccagtggaactacagagacctggacccagctgcactattttaatgtaaaaataacagtatggccaggtgcagtggctcacgcctgtaatcccatcactttgagcagccaaggcgggcggatcacgaggtcaggagattaagaccatcctggccaatatggtgaaaccctgtctctactaaaatacaaaaaattagctgggcatggtgttgcgtgcctgtagtcccagctacttgggaggctgagacaggggaattgcttgaacccgggaggcagagattgcagtgagccgagatcacgccactgcactccagcctggcgacagagtgagactctatctcaaaataataataataataataataataataataataataataacagtatatttggtgtcaggagagggctcaattctcatttctgcctttcctgtgctggctcatggtagctgggcatgacttgccttcctacataggttgtcttcatacatatgcactgggaatcaataaaagcccatggtgagaatgaacatccccttaatgttccttactatccccaacccctgaggcctcacctactgccctgccatgtggagctacttgccctggggctgccagtcacacattcctcggtcctacttctctgaccccgtttgactctgcacctgagccctaatgcttacttcagtgacctgaactttgacaagtggcttttgtcctgcacctcaggtttgacctctgctctcccttgaccttgactgtgacatttgacctttggctttaatcattacagcctcagataaaggtaccttcagcccgggcacagtggctcacgcctgtaatcctagcactttgggaggctgaggcaggcggattccctgagctcaggagttcaagaccagcctgggcaacacggtgaaaccctgtctctactaaaatacaaataattagctgggcatggtggcatgtgcctatagtcccagctacttgggaggctaaggcaggagaatcacttgaatctataaggcagaggtggcagtgagccgagatcacaccactgcactccagcctgggcaacggagcaagactctgtctccaaaaaaaaaaagaaagataccctcagtgtgccaggcctctaagagctcacctgccaggcttcctccttgctccactgtcccatgtaattccatatatgaagctaccactgtacatctctcttttccggtgcctgttgagttgcatagaagcacagttgtgtttattttgtttttagggttgccatgggcaatttccgtgccacttttaagcagtgttgcactgtgaagagaatgtaggcaagtttatttctggaatggtttcttcttacaatcagaatagttaggatgtaatatatttttgggtgggcatttaaagtgaaaaggtacatatttacatagacacaggtgataatgtatctatgtaaatgccttttgattctgcaactgcaggatactctcatcaaagacacagataaaaagcctctgtgtttccaaggccttgccctacacctaacacataatatgtccaaatggatgaagaggaggcaaggacaaggatgtgatgacaaaacattctgttatgcacttgtagcatttatgtttcttcctgggggattttataatactaaaagaatcataatataaagagatgattaaaaaaaaaatactgccgggcacggtggctcatgcctgtaatcccagcattttgggaggccgaggtgggcagatcacctgaggtcgggagttcgagaccagcctgaccaacatggagaaaccctgtctctaccaaacatacaaaattagccggggatggtggcgcatgcctataatcccagctactcgggagtctgaggcagaagaaccgcttgaacccgggaggcagaggttgtggtgagccgagatcgcgccatcgcactctagcctgggcaacaagagtgaaactccatctcaaaaaaataaaaataaaataagtaagtaatacctaaaattctgcaaccttcattttactatagatggttgaagattatattacttcttaattgttttagccttgttattgcttcattacttcatggttgttgagtacagatgctcagtaatcataacctatgaaatatttgacaccatgatctaaacattaaaaacaaataactgtgctattgccacagctatgttttggctttgaattttctttactgaatattttggatcaagaacactagatgagaaacctgttcaactctgttcttttttttttttttaactccactgtatttattacctgtttttgttttttttgtttgtttgtttttgatgtgcatatagaccaagatgtggtaaatttaaatggcagatgtttttgatgtggtacatttaagggagagaaagcagtttaaagagcagggtgaaaaatccaacaagactccatcgagagtttctgagctctcccatcaggggccagtcctcctttcctctctcctcttactcccatgatttccaagttgtgatcctttccttatttctgaggaatgacttggtttctcctcttctttttttggcctgagagaagatgtttttgcacttgtagctatgaggaacagattgtccactagggaggccagctgatcattttctgccagagtcacacagagcagtcacaccttattttgaaaaccactgtctggggtctttgtcctcacatatgcaggtctagtgtccccacaaagtgatcagatggatatataaagtggagtgccaatgtattaatttactgtgagaaacacaattgctaagtgggtcagatatctgtctcagctggtcagtacaccttccagcaggaaaatctacataagaacaactaaatcacaatctgtagagtgcttgatgaccccagaattggtgcaaggggacacattcttgcttgttagcacctgctctctggagtttgctattttctcacacacagtgtattagttcacagaatgttctccaaggaggacagggggctttgcccatagccatgtgctgtgggcagcagagctaggaagaagcacaggcatctcccagcccaggtgtttcccacttaactgcattgcccttttcatcttttttttttccccaatagcttcaggacattcagtacattgtgctttttagaggttgatgattccactgcctgagctgccttcacctctctttctttggaaattgccatctttgagcattgtatgtctctgtaacatctctgcatctccttttcactctggcctccctttctccattgtccttctagcttctggttgccccaaaccccacagactgtgtaacaaaacccaaaacctattggtttaaaacaatacccattttattttctttcatagtttctatgggtcaggaatttggatatggcttgggtaagcagttctggcttctcatggagttggaggcaagtggtggctggaacagaaatggggcagccaggggtggtggccaggcatcagctacatctcctccatgtagtctcaggaactctccatgtaatctctctgtgtgggttgggcttcctcacaacatggtggcctcagggcagtcactgcttacatggcagctagcttccctcagagtgagtatcccaagagatcacagtcaaagtgcatagcatttatataatctaatcttggaagtcacaaaatgtcattcttgtgatactctcattggtgaagaagtcataaaatcctgctcaggttcaaaaagagggtgtatagaacccaacactcaataggaagattgtcagagttacattgtaagaagagcatgtagttgggagatatcattgtggccattttgggaaagatgcaacatgtcacaatgtcatgttctccatcgtctccccgttccaccttgtactggtttccaagggtagtcgtttaaaagtaccacaaaaactgggtggcttggaacaacagaaatttattgtttcacagttctggaggccagaagttcaaaatgaagtgttggcagaaacatgctgcctctaaagggactgggaaaggatctgttccaggcttccctcctatcttctggttgttccttgccttctggctgcgtaactctagtcttcatttggtgttctccctgcatgcatggctttgtgtccaaatttccttttttcatgaggccatcagtcatactggattagggacccactctactactgcaggatgacctcaccttcccaaattacatctgcaacaaccctatttccaaagaaggccacattctgaggtactgggggttataacttcaacatgaattttttggaggaaacaattcaactcctaacacatctctacccaacctctgtaggttccctcaatccaccaaaattttttggctccactggattatctagcagttaggaaaccaagatcattaaatgaattcaccgcaactacagtgagactgactaccttagcttacctctgtgaaaggagttaagccaaaggaatctgtggaattttggagagtttgggagcatttgggggcaggaggcaaatgttcttcctttaaatcacaacacttagttctcttccatttataagactcacccctccatcccaacccctgcaccacaggacaaggaagtgttcttggtcttcaactttcatccctgatggtgaaagcagttgctcctgacctatttgcccaccagcttctcctctggagcctgaggcttctgatgcctgcctggctggttctcagtaagaaggtcaagttcaaccagaggggagatgctgatgcctttcagtacttaaatatgagttcagaccctggggcctggacataagatttggggtcccctggatataagatttctgaaaacactcagactgtggagacccctgctgagggagaagccccaaactgtggcttcaggggaatgcaccaaggctctcattgaggccaccttctccaacaagctcccctcctgcttccccatggctggcatggctgaggaaaaaggacactgagcacagcccgtgcatgagcggcttgccatgcaacaggataaaacccataatgccactcagcaagccttggttgtaaatctagtttgattacatttgtaatcaaatgatggccatttgttctgtttctggtttgtgaaccaactgaagacataagcagggcctcagctaacccacaaatagcacatgtgtgcaaactggaaaaatgaacccttcttctgggaggacgccagcccaggccaggtcacccggcttggccagcagaacacagagtagattttggtcccgtttgttccccagtggggtatctatccttgtgcagggcacaagcctacatggtggctctggtcatatcattagaaaatagacagaaatgggctgcacaccagaatgaatgaattgaattgaaagggaggagtgatggtggaaaaaaaaacaagtcaattcatttagactggtagaaccagaaccactgtgtagtacatccaaacggttaaaattccctggaagatgttacataatcctatcatggtgtttatttatggaaatctattttaaaaattttatgtaatactgcacagtctgtttgcatgatgccttgtacgtagtagcaactcagtaaatactttttgaatgaactagtatagtattttaattagctagtcttcatgtactggtacaaaagaacagtgtcatcttacagctgaagtcatagaggggaaatatcccactcaagatcatataacattccaggtactcaggatgaatggtttgaggactggtctgaattcttcaaaggtttcagctgtattaacattctccatctaataaactttatcttgtcattgca

SEQ ID NO: 151262 - DNA, 2599 bp, Homo sapiens
  Payload ID: 9782
  Gene Symbol: MIP
  Gene Name: major intrinsic protein of lens fiber
  Uniprot ID: P30301
  ENST ID: ENST00000257979
  CDS Start-End: 30-821
acccaggcactgtgaccatcccccctgccatgtgggaactgcgatcagcctccttttggagggccatattcgctgagttctttgccaccctcttctatgtcttctttgggctggggtcctcactgcgctgggctcctggacccctgcatgttctgcaggtggctatggcatttggcttggccctggctacactggtgcagtctgtgggccacatcagtggagcccacgtcaatcctgcagtcacttttgctttccttgtgggctcccagatgtccctgctccgtgccttctgctatatggcagcccagctcctgggagctgtggctggggccgctgtgctgtatagcgttaccccacctgctgtccgaggaaacctagcactcaacacgttgcaccctgcggtgagcgtgggccaggcaaccacagtggagatcttcctgacgctccagttcgtgctctgcatctttgccacatacgacgagaggcggaatggccaactgggctccgtggccctggccgttggcttctcccttgccctggggcacctctttgggatgtattatactggtgcaggcatgaatcctgcccgctcctttgctcctgccattctcactgggaacttcactaaccactgggtgtactgggtaggcccaatcattggagggggtctgggcagcctcctgtacgactttcttctcttcccccggctcaagagtatttctgagagactgtctgtcctcaagggtgccaaacccgatgtctccaatggacaaccagaggtcacaggggaacctgttgaactgaacacccaggccctgtagaagctccagctgaatagagggagtagaaagcttctgagtttacgtggaggggtttagccagcccctagatgaagaaagagactgtggggagggtcatgtacttctttattttttaacttatgtatgtggttgttttttttttttttttccttttgctgtgtgaaatctttcaagttgcattcatgagctggttggtgcaaacttcccttcctccccatcccaccacccttcgccgtgtgtgctgattgtgcatatgaatgtgagtgtggctgtgtctgagttttggggcatgagagctaaggaagcaaaaagaggtgccatcctatacctcccttcctcgacccagtatggtgagtactgggtaaccgacaccttaagtttctggcctttaccctgctgccagtcaagtgtgtggctcttgatttctgagggaacagagaagcagggagttactcctcacacgaggcagatggagagaagtggaggagacaaggcttccaagggttaggagaagggactcaagggaggtgggtggtgaaaacggagtattagccccagatcaggatgtaggtgtaccgaagaattggggggaagttaatgggaatatatagcctacttatcttagggatgcttgccccagggacttgggtggggaagtagctctgagaaaagtgaacactaggatttagctgttctgtaaagccacgtaaacctgtctacatccgctggctggttgtgttcattctgacataatggatctcttcagaggtcctgggccaaagagcttccaacctaaatagagcttgggcaagcctagaatctagaaaaattaagcagcttaactggtcagcctgacatccactgttgtggctgcctggcagatggtatttaagccccacaattgttccctaaggccaacacaggaaatctgattcctggagcaaataaatgaacgggtggtagtagggggcatgaggggagaggctttgactctgttctaatttatttagagcaaatcaaaacactcctcaaatggcatctttctgcttttatcactagttccgtgttttttttcttgttttgtgtctgtgtattttcatttctctgtcatccgtcctttcatcttgaagcaaatctcttctaactccctcataccccagaaattgattccttctattcaaatgcttaataattcaggagattattatttgtttgagccctatcttctttttttttttgagagggggtcttactatgttgaccaggttggagtgcaatggatattcacaggcacgatcatcgcacactacagtctagaaatcctgggctcaagcgatcttcctgcttcagcctccccagtagctgggattacagggggccagagcacagccctattttcttttccttttggcaagatcatctcagcagaggccagaagagaccctcaactgttcaatgaatatttacggttgctttcttccttttatgagcctcttgcatactttgaaagctttaaatttatacctataatacaacggacatcccctatcccagaagaccattcctccctgtacttcagctctttacttcctcccaaataaaacctaacttttctaactaactatttaagacttggaatagtccgcttgactagaagaaggggaagaatgtttgtaaattcacctctaatcggactttgattctactataattcagcagaaaattcatagcgctgtgatttttagatcgacctcacataaaacagtccctgcactcgc

SEQ ID NO: 151263 - DNA, 2870 bp, Homo sapiens
  Payload ID: 9783
  Gene Symbol: MVP
  Gene Name: major vault protein
  Uniprot ID: Q14764
  ENST ID: ENST00000357402
  CDS Start-End: 139-2820
acccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaacactt

SEQ ID NO: 151264 - DNA, 2925 bp, Homo sapiens
  Payload ID: 9783
  Gene Symbol: MVP
  Gene Name: major vault protein
  Uniprot ID: Q14764
  ENST ID: ENST00000395353
  CDS Start-End: 194-2875
aactcccaagccccacccctgggcttggcctgccttgccctgccgggaagtgatccccaaggcagggtgagagttccccatctgaggcgtttgttgcagctacctgcacttctagatgctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaacactt

SEQ ID NO: 151265 - DNA, 211 bp, Homo sapiens
  Payload ID: 9783
  Gene Symbol: MVP
  Gene Name: major vault protein
  ENST ID: ENST00000565164
  CDS Start-End: 86-211
gagcactgggtcggccctcgggtgtggctgtttgggcaggacagccctcttcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagg

SEQ ID NO: 151266 - DNA, 548 bp, Homo sapiens
  Payload ID: 9783
  Gene Symbol: MVP
  Gene Name: major vault protein
  ENST ID: ENST00000563558
  CDS Start-End: 115-548
atctgaggcgtttgttgcagctacctgcacttctagatgctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggccatccctctagacgagaacgagggcatctatgtgcaggatgtcaagaccggaaaggtgcgcgctgtgattggaagcacctacatgctgacccaggacgaagtcctgtggga

SEQ ID NO: 151267 - DNA, 548 bp, Homo sapiens
  Payload ID: 9783
  Gene Symbol: MVP
  Gene Name: major vault protein
  ENST ID: ENST00000566066
  CDS Start-End: 266-548
atctgaggcgtttgttgcagctacctgcacttctagatgtttcggccctgcggagaaccctccaagggagcagtggaaaaagcttcacttggcagtaaagcccctacttgctgttccatccctgcagctggggtgaaataagccactgaccagtaaacaactgaggcttaaaccagcatgccagctcaggctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccagg

SEQ ID NO: 151268 - DNA, 549 bp, Homo sapiens
  Payload ID: 9783
  Gene Symbol: MVP
  Gene Name: major vault protein
  ENST ID: ENST00000569887
  CDS Start-End: 69-188
aggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtgga

SEQ ID NO: 151269 - DNA, 589 bp, Homo sapiens
  Payload ID: 9783
  Gene Symbol: MVP
  Gene Name: major vault protein
  ENST ID: ENST00000566859
  CDS Start-End: 95-340
aaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctga

SEQ ID NO: 151270 - DNA, 854 bp, Homo sapiens
  Payload ID: 9783
  Gene Symbol: MVP
  Gene Name: major vault protein
  ENST ID: ENST00000563915
  CDS Start-End: 194-854
aactcccaagccccacccctgggcttggcctgccttgccctgccgggaagtgatccccaaggcagggtgagagttccccatctgaggcgtttgttgcagctacctgcacttctagatgctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatcc

SEQ ID NO: 151271 - DNA, 658 bp, Homo sapiens
  Payload ID: 9783
  Gene Symbol: MVP
  Gene Name: major vault protein
  ENST ID: ENST00000570234
  CDS Start-End: 213-658
agcactgggtcggccctcgggtgtggctgtttgggcaggacagccctctgtatgtagccttgagcagctgtgggaaggtctgggggcagggccgcatcaccgaccttacgtccaacctcaggactgcctggagcaagagccctggggttggggacaaaggaggctgcctggacctggtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctgg

SEQ ID NO: 151272 - DNA, 408 bp, Homo sapiens
  Payload ID: 9783
  Gene Symbol: MVP
  Gene Name: major vault protein
  ENST ID: ENST00000566252
  CDS Start-End: 87-408
attcctgaacaggccaagcactgggtgaaactactcaggattcagaagcagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaagg

SEQ ID NO: 151273 - DNA, 525 bp, Homo sapiens
  Payload ID: 9783
  Gene Symbol: MVP
  Gene Name: major vault protein
  ENST ID: ENST00000562463
  CDS Start-End: 74-247
atctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggtggggtcaccaaggggcgatgatggtgggtgggcaggaggggtccccactgcaggggaagcaggggaagg

SEQ ID NO: 151274 - DNA, 575 bp, Homo sapiens
  Payload ID: 9783
  Gene Symbol: MVP
  Gene Name: major vault protein
  ENST ID: ENST00000563123
  CDS Start-End: 1-185
caggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggtggggtcaccaaggggcgatgatggtgggtgggcaggaggggtccccactgcaggggaagcaggggaaggttgaggaaagcctcctgtagccccagagaggcgctttcctggtatcttttgaaagctgttgagggccacccactgctcttccttccccacccccgcttcatgctgtttccacttgggctggaaaatgtgaccatgaccatgcggatgtggcttttccttccctcaccttcaccatgagctgtgggcagtggccatgacttacctgattctggatcaacaaagaagatgttcaaatacaattgacaaatgtaggccaataggggaagaatggctggtcaccacagtaggggcgtacctcccagcggtgtttgaggaggttctggatttggtggacgccgtcat

SEQ ID NO: 151275 - DNA, 120 bp, Homo sapiens
  Payload ID: 9783
  Gene Symbol: MVP
  Gene Name: major vault protein
  ENST ID: ENST00000629059
  CDS Start-End: 1-120
atggcaactgaagagttcatcatccgcatccccccataccactatatccatgtgctggaccagaacagcaacgtgtcccgtgtggagtgtcccgccgcactggggaggagtggctggtaa

SEQ ID NO: 151276 - DNA, 3991 bp, Homo sapiens
  Payload ID: 9784
  Gene Symbol: MAK16
  Gene Name: MAK16 homolog
  Uniprot ID: Q9BXY0
  ENST ID: ENST00000360128
  CDS Start-End: 458-1360
ggagcggggacccagccccgccgcgccgcctgcagctttccccagcctcctcccagcagaggggaggcccgacagggaggggtcccatcctcatgaacggtcacaaacagggcgctagggaagcacgcccgacccccgcggtccccgcgctccaggattcggcagactgcgcgcgtcctgcctcccgcggatcgcactgggtcccaacagggttcccagctccaggctgcgcccatgaacaagcccagcattgcggacgggcgcgcgcagacgccagcgtggtgaagacgcgggggcgcgcgcgcggcgacgagactgccaggggacgcttcgcaacaccgagagtctcagcgtttctcgagataggtgaggctgcgcgttccggaactggtttcccggaaggagcatgtctgcgcccgcgatccgaccggaagttgcacgctgagccgcggacaccatgcagtcggatgatgttatctgggatacactaggaaacaagcaattttgttccttcaaaataagaaccaagactcagagcttctgccgaaatgaatatagcctgactggactgtgtaatcggtcatcctgtcccctggcaaatagtcagtatgccactattaaagaagagaaaggacagtgctacttgtatatgaaggttatagaacgagcggcttttcctcggcgtctctgggaacgggtccggcttagtaaaaactatgagaaagcactggagcaaatagatgaaaatctgatttactggccccgtttcattcgacacaaatgtaagcagagattcaccaagatcacccaatacctaattcgaattagaaaacttacactaaagcgacagaggaaacttgttcctttgagtaagaaggtggagcgtagggagaaaagaagagaggaaaaggcattaatagctgctcagctggacaatgccattgagaaggaattactggagagactgaaacaagatacgtatggcgacatctacaacttccccattcatgccttcgacaaagccctggaacaacaggaggcagagagtgactcttcagatactgaggaaaaagatgatgatgatgatgatgaggaagatgtggggaaaagagaatttgtcgaagatggtgaggtagatgagagtgacataagtgattttgaggatatggataaactggatgccagcagtgatgaagatcaggatggtaaatcctccagtgaggaggaggaagaaaaggcccttagtgcgaaacacaaaggcaaaatgcccttgagaggaccactgcagagaaaacgagcctatgtggaaatagaatacgagcaggagacagagcccgtggccaaagccaaaaccacgtgatttccctttcagcatttatacccaggactgaacatgcagaactgttttttttttttttttatcttaaacacatacacacctccagtttttgctcttttgtgttgtactgaacacaatatttgtgtttttattatttatgccacgtcagtggggcaagaaatctggagtgagtgaagaaagctaagttgtgaacaagagtgtttttatagcatatgtgttgaagtaacagcttgtgcccgagaaacttaacagatgagttcttgaatctgggatgagatgacggatgtaaatatttctaaattttaaatgctacattacttggtgtccttttttctcccaaactttatttagaaatggaaggagttcaattttttcttgttctactttccctattcttatggaggtaaaaggaaaggaaggaaggaaaaagcagctttcacttacaaagtttcgtgtaaaaatatctttttttcttaaataactccattcatacaaattgggatgggaagaaaatcctttcctcttgggaaagtaatacaagtcttaagttccattgtagggtgcgccttcagaaacctgctgcacttttctgatatagttcaccacttttctgtcttcacagctttggggaattttggccaggagaccctgaaacatgaaaccaaacaggctttgatatttttttttttttaattactttccccttttgcttgattcttcttccttggtatcatattcaaaggaggaaagaatggatgacacttagggacaggtcactaagcagaataggtattagttggttttttattatttttaaatttatatagctctcatgtattgaaggtgctactttaaaaactgtgttaatgtacttgcaaatctcctgctggctcatgaaacagcagaattccagccaaggcaaattcagttggatctagggcttgaaaactgcccaagattaaagagctaagatgaaatagtttgaataaactggtaaaataacaattcatactatctctacatatttttaggatatgaatttttttttcctgctgggtagattgtccagtgacttatggcatgaatttcttttcatgctaccttcaatcttcaactaaagatttctaaaaggggtaagaaatgaggcagtagtttattaaatacatagaagtacacagctattatatgctgtggctttgagaagttaacttttgtggaatatgaaaccaaaggaagaatttccatgtagataaattaagaatagggaaaaacatctacctaaaagatggttgtccctaaaaaactggaaacatctgaaatgctctatttatgttattattcctgggagcttatagcccattatttttactttttttttttaattcagaagactagaacagaacttaaattttacaaacttttgatcataatgcttttgcccatactgtctcgtccttagccccagtgacatgtgctgatcctcctgcctttagttctaaatggttctgaatagctttaaaagatgaataagaaaaaagatcaagctcttttgaggctagagggctcatatggagatctaaaaccctccatgttcatttccagacttggtcaggcacatacatagtaaattataatcaatcatgggaattacataaggataatgaggcccaactgaaaccaagtttcagtctgccttacctttacccgtccttgagaacagcggtccaggagaatcaggcagtctgtggcctcctgtagcagggcgctcttaacagactcaggtgtaaggtttggatcccttgctacatcacaaatcagtttcaagagggccttcagtaagaccacaagtctgcaggaaactctggaatcaggaagaaaagctatgttcatactctaaatctggatattaaaattggaagagacttcaaagactgtcaagtggaaagctatcatttcctaaattaaggaacttaggtcaaagttaaatgaaaaagacctaaaaacagaaccaaagacagcctctagatttcttaccctcaagtctcctgttagcatactgcctatacacacagacacaccctctgccacactgctctcttccttccagaagcttggttctactgtaagcaacagctccttcatgggctgagaaggggaaaccaggatctccccaaccaagggcctatacttttatttttcaactctattaactgaactatgcttggagagagccctgaatcctttaactttaatgccatcttaggcctggaagttagagtgagggaaatgagcttggcttctgggactgtgtcaagttgaattttctgtcatttaatttcagatcctagctcatcatcagtgaagtccagcctacttacttgtaactattaacctttctaaaagttttcatcgccttggtaaagctccagaaatggacaatgctagtgactgcacaatattgtgactgtacttaatgccactgaactgtacactttaaaatggaaaatttatatgtatttttaccacaataaacaaaaaaccctaaaaaaactttaatgaaaggtggaaaataatttaacttacaatgtgaaaatacaatgtgaaatgtacaataaatcatatttatggaca

SEQ ID NO: 151277 - DNA, 872 bp, Homo sapiens
  Payload ID: 9784
  Gene Symbol: MAK16
  Gene Name: MAK16 homolog
  ENST ID: ENST00000518389
  CDS Start-End: 1-412
ggacaccatgcagtcggatgatgttatctgggatacactaggaaacaagcaattttgttccttcaaaataagaaccaagactcagagcttctgccgaaatgaatatagcctgactggactgtgtaatcggtcatcctgtcccctggcaaatagtcagtatgccactattaaagaagagaaaggacagtgctacttgtatatgaaggttatagaacgagcggcttttcctcggcgtctctgggaacgggtccggcttagtaaaaactatgagaaagcactggagcaaatagatgaaaatctgatttactggccccgtttcattcgacacaaatgtaagcagagattcaccaagatcacccaatacctaattcgaattagaaaacttacactaaagcgacagaaaaggcattaatagctgctcagctggacaatgccattgagaaggaattactggagagactgaaacaagatacgtatggcgacatctacaacttccccattcatgccttcgacaaagccctggaacaacaggaggcagagagtgactcttcagatactgaggaaaaagatgatgatgatgatgatgaggaagatgtggggaaaagagaatttgtcgaagatggtgaggtagatgagagtgacataagtgattttgaggatatggataaactggatgccagcagtgatgaagatcaggatggtaaatcctccagtgaggaggaggaagaaaaggcccttagtgcgaaacacaaaggcaaaatgcccttgagaggaccactgcagagaaaacgagcctatgtggaaatagaatacgagcaggagacagagcccgtggccaaagccaaaaccacgtgatttccctttcagcattt

SEQ ID NO: 151278 - DNA, 3151 bp, Homo sapiens
  Payload ID: 9785
  Gene Symbol: MKRN1
  Gene Name: makorin ring finger protein 1
  Uniprot ID: Q9UHC7
  ENST ID: ENST00000255977
  CDS Start-End: 226-1674
accaatgagcggcgccgtgggcgggccgcgggcgcgcatgctctgggcccgcagttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaagttggctgttc

SEQ ID NO: 151279 - DNA, 1601 bp, Homo sapiens
  Payload ID: 9785
  Gene Symbol: MKRN1
  Gene Name: makorin ring finger protein 1
  Uniprot ID: Q9UHC7
  ENST ID: ENST00000443720
  CDS Start-End: 156-1145
gctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacgaaa

SEQ ID NO: 151280 - DNA, 460 bp, Homo sapiens
  Payload ID: 9785
  Gene Symbol: MKRN1
  Gene Name: makorin ring finger protein 1
  ENST ID: ENST00000463142
  CDS Start-End: 1-339
ttgtttcccaggtcctgcccagaatgccggatcacatctaactttgtcattccaacaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtccc

SEQ ID NO: 151281 - DNA, 1390 bp, Homo sapiens
  Payload ID: 9785
  Gene Symbol: MKRN1
  Gene Name: makorin ring finger protein 1
  ENST ID: ENST00000495305
  CDS Start-End: 25-552
ctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagtcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaa

SEQ ID NO: 151282 - DNA, 1661 bp, Homo sapiens
  Payload ID: 9785
  Gene Symbol: MKRN1
  Gene Name: makorin ring finger protein 1
  Uniprot ID: Q9UHC7
  ENST ID: ENST00000474576
  CDS Start-End: 156-1412
actgcgtcaacccccgctgggccgcggagccctcagcgctgtccgcggaggcctggcggtgcgcgattactgcggagccgcggggctgcaccgccgcttacacttccctgagcgctgcctgagctggctgcgagcgcatcggggagaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtca

SEQ ID NO: 151283 - DNA, 1625 bp, Homo sapiens
  Payload ID: 9785
  Gene Symbol: MKRN1
  Gene Name: makorin ring finger protein 1
  ENST ID: ENST00000496169
  CDS Start-End: 12-293
gataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcagacggagtctcagtggcgtgatcctggttcactgcaacctctgggccccccccaacccactgcgagttcaagcaattctgcctcagcctcccaagtagctgggactacagtaggtaccgctttcaccatgttggtcaggctggtctcaaactcccaacctcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacgaaagaaaaa

SEQ ID NO: 151284 - DNA, 1133 bp, Homo sapiens
  Payload ID: 9785
  Gene Symbol: MKRN1
  Gene Name: makorin ring finger protein 1
  ENST ID: ENST00000467513
  CDS Start-End: 639-1133
gtttgtaacgtcttttcacgtccctccgtccctccgccccccatcctccgcccaactgtgagaagaagcttttgtatttcttctttgtatgtttgtcgaggttggcggtgctgagctttgtcttagaagcaggcgttcgggggccggggtcgtcttctccacccgcggtttttttgagctgcagattattaccctcccccagcgctatgttcctcttttgaaatttacgcatcttccgaagggagtgaaagggctcttcgctcccggaagagagagaggtttggttttggtttgatatgcgagacgaaaatattagaaaaattaagggatggcggttgtatggatgtgtatggttgtaaaaaactacctagctctacgcagaagagggcatttaattgtacgttttttattttccggtttttaaatagtgatcagtagcgactgtaagcttttctttttctatcagttgaataaatcaactgaaatgccggttttcacctgggtggtataatttatatgcaaacggagtctcagtggcgtgatcctggttcactgcaacctctgggccccccccaacccactgcgagttcaagcaattctgcctcagcctcccaagtagctgggactacaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtg

SEQ ID NO: 151285 - DNA, 720 bp, Homo sapiens
  Payload ID: 9785
  Gene Symbol: MKRN1
  Gene Name: makorin ring finger protein 1
  ENST ID: ENST00000473444
  CDS Start-End: 415-720
gtctcgatctctgcagccctcgcggcccccgctgccgccgcgttcccccagtcactgcgtcaacccccgctgggccgcggagccctcagcgctgtccgcggaggcctggcggtgcgcgattactgcggagccgcggggctgcaccgccgcttacacttccctgagcgctgcctgagctggctgcgagcgcatcggggagagacggagtctcagtggcgtgatcctggttcactgcaacctctgggccccccccaacccactgcgagttcaagcaattctgcctcagcctcccaagtagctgggactacagtaggtaccgctttcaccatgttggtcaggctggtctcaaactcccaacctcagtgtctcatggagacagagtctgcacagtggaaggaacttcagaaataatatatggcccaggttttcaccgaaggcaaactcaacttggggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtca

SEQ ID NO: 151286 - DNA, 1053 bp, Homo sapiens
  Payload ID: 9785
  Gene Symbol: MKRN1
  Gene Name: makorin ring finger protein 1
  ENST ID: ENST00000471104
  CDS Start-End: 475-1053
agaggcgcgggagggcggggaccggcgttgtctcgatctctgcagccctcgcggcccccgctgccgccgcgttcccccagtcactgcgtcaacccccgctgggccgcggagccctcagcgctgtccgcggaggcctggcggtgcgcgattactgcggagccgcggggctgcaccgccgcttacacttccctgagcgctgcctgagctggctgcgagcgcatcggggagaggtgggctggctcctcccctgccgctggaaggatgcccccgccgctgcctccggctcccggggctcgggaggtggtcacttgaggccggtctcccagcgatcctctccgggcctagacaccccgccgagggccccagcgagcttgcctggctcccggccctctcctctctccgtgccatccgtttgtaacgtcttttcacgtccctccgtccctccgccccccatcctccgcccaactgtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaa

SEQ ID NO: 151287 - DNA, 560 bp, Homo sapiens
  Payload ID: 9785
  Gene Symbol: MKRN1
  Gene Name: makorin ring finger protein 1
  ENST ID: ENST00000475180
  CDS Start-End: 1-120
tggactaaacaggtcacctgcagacggagtctcagtggcgtgatcctggttcactgcaacctctgggccccccccaacccactgcgagttcaagcaattctgcctcagcctcccaagtagctgggactacaggctggagtgcaatggcgcgatctcggctcattgaaacctcagcctcccacgtgtaagcagttctcctgcctcagcctcctgagtagctgggattaacatgtgtgccaccacaccagccaatttttgtatttttagtagagacggggtttcaccatgttgcccaggctggtctcgaaccgctggtcttagacccctgacctcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgat

SEQ ID NO: 151288 - DNA, 607 bp, Homo sapiens
  Payload ID: 9785
  Gene Symbol: MKRN1
  Gene Name: makorin ring finger protein 1
  ENST ID: ENST00000498535
  CDS Start-End: 11-337
ataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcagatggagtctgtgtcgcccaagctggagtgcagtggcacgatctcggctcactacaacctctgcctcctgggttcaaggaattctggtgcctcagccttccgagaagctgggattacaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtagg

SEQ ID NO: 151289 - DNA, 784 bp, Homo sapiens
  Payload ID: 9785
  Gene Symbol: MKRN1
  Gene Name: makorin ring finger protein 1
  ENST ID: ENST00000494939
  CDS Start-End: 377-784
cttctccacccgcggtttttttgagctgcagattattaccctcccccagcgctatgttcctcttttgaaatttacgcatcttccgaagggagtgaaagggctcttcgctcccggaagagagagaggtttggttttggtttgatatgcgagacgaaaatattagaaaaattaagggatggcggttgtatggatgtgtatggttgtaaaaaactacctagctctacgcagaagagggcatttaattgtacgttttttattttccggtttttaaatagtgatcagtagcgactgtaagcttttctttttctatcagttgaataaatcaactgaaatgccggttttcacctgggtggtataatttatatgcaagtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatca

SEQ ID NO: 151290 - DNA, 906 bp, Homo sapiens
  Payload ID: 9785
  Gene Symbol: MKRN1
  Gene Name: makorin ring finger protein 1
  ENST ID: ENST00000480552
  CDS Start-End: 98-433
gtgcgcgattactgcggagccgcggggctgcaccgccgcttacacttccctgagcgctgcctgagctggctgcgagcgcatcggggagaggtattttatgcatggggtttgtaaggaaggagacaactgtcgctactcgcatgacctctctgacagtccgtatagtgtagtgtgcaagtattttcagcgagggtactgtatttatggagaccgctgcagtcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacgaaagaaaaaggagtc

SEQ ID NO: 151291 - DNA, 2848 bp, Homo sapiens
  Payload ID: 9786
  Gene Symbol: MKRN2
  Gene Name: makorin ring finger protein 2
  Uniprot ID: Q9H000
  ENST ID: ENST00000170447
  CDS Start-End: 138-1388
cacaccggaggggcggcgtgcgccggcgtgcgccggcgtgacgcggctacgcgggatgggccgggccagggccaaggccgaggcggcagcggctgcgagaggcggcggcacgacgacggtccctcagcccagccaccatgagcaccaagcagatcacttgcaggtattttatgcatggtgtgtgtcgggaaggaagtcagtgcctattctcacatgacttggcaaacagcaaaccgtccaccatctgcaagtactaccagaagggctactgtgcctatggaactcggtgcagatatgaccacacgaggccctctgctgcagctggaggtgctgtgggcaccatggcccacagtgtgccctccccagctttccacagtcctcaccctccttccgaggtcactgcatccattgtgaaaactaactcacatgaacccggaaagcgtgaaaagagaacattggttcttagagaccgaaatctctctggcatggctgaaaggaagacccagccgagcatggtgagtaatccaggcagctgcagcgacccccagcccagccccgagatgaagccgcattcctacctggatgccatcaggagtggccttgatgacgtggaggccagcagctcctacagcaacgagcagcagctgtgcccctacgcagctgctggggagtgccggtttggggatgcctgtgtctacctgcacggggaggtgtgtgaaatctgtaggctgcaagtcttgcacccattcgacccagagcagaggaaggctcatgaaaagatctgcatgttgacgttcgaacacgagatggaaaaggcctttgccttccaggcaagccaggacaaagtgtgcagtatctgcatggaagtgatcctggagaaggcctctgcttctgagaggagatttgggattctctccaattgcaatcacacgtactgtttgtcctgcatccggcagtggcggtgtgccaaacagtttgaaaacccaatcattaagtcttgtccagaatgccgtgtgatatcagagtttgtaattccaagtgtgtattgggtggaagatcagaataaaaagaacgagttgattgaagctttcaaacaggggatggggaaaaaagcctgtaaatactttgagcaaggcaaggggacctgcccatttggaagcaaatgtctttatcgccatgcttaccccgatgggcggctagcagagcctgagaaacctcggaaacagctcagttctcaaggcactgtgaggttctttaattcagtgcggctctgggatttcatcgagaaccgagaaagccggcatgtccccaacaatgaagatgtcgacatgacagagctcggggacctcttcatgcacctttctggagtggaatcatcagaaccctaaagagtagatggttgccctgcatcttgggctccatcggccgaaactttcccaagccagggtgtgcggagcttccctgtactgcagccaaggtgacgtgtgacttggatttgagtggagttgggcttagccttagtctcattcaatctccattattacagccatggggaagagtgaaagatataaagtaacctaattaaatgtatggaattgctatttttatagctgatatagttacacctcaagcccctcaggggtaacaactaacaaacacccaaactgtttggattgattgctttaaaaaacaaacctggctcttacctttgatcttttcttccccagaaatagtaaacttgcagctgcccctaatgcagcatatttttcttaccaaaggagtcttcagccctataaaaggattcctctatagtgtatttctctagtgtatttagtgtgtcgtcaaaattttgatttatacagagctttcaagaacacacaatgcaaagtgagcgcagcatagctgttaacaaacatacaacttttttctagggctttaagggtggtcatttttttcaagttctctcaagtgtcccaaatcagggtagcaatcttgttgccacatgtgcagcaaacaaagtggaagtatagatcttcttctcccttagggaggctcttgaaggagcaggaggtacagtactgggtagcagtctggccctcctgtcgtctggttggtgttggggcctccagccagggccctctaggggaaccaagcctctgctctcacctgtgggttcttgcccatcagggtaattgtattgagaactcaaatatacgtgcacttacatgtgtggttcgtactcaagtgatctattatctagctgcaaagcctggctttgatttgaaattttgtaaaaatttcatggcacccaaggtttctgattctgacccagcagtggtcctgaagagagctgatggcaagtcttgtagtcattttgattttaattgaagggtgagcataaccttgtgaaccagcactagcttgttccaagctggaatttatctaatctatttttgtgtttaaaaaagctgtacctaccaaataaataaatagtttataaaatgtattacttaaggtattagctgagtttagagtactttctgcttaattaatttttatacttaactcttcagtagaggtttacaaagagtacaaaggttaaattacaaattcattcccagcctaggctctgggcacatttcctgttcttgaattctgctcctgaagagggtgaacaaatggggcattcaagttgtgagctcagaattactttaaaaggaggtaacagccagccattacacctaaatttaatttattttattaaaataacataattgagggaccatcagataactgtattttgtcaggtgcaataaaaacaaaattaaaacccaaatcatcaagaaaa

SEQ ID NO: 151292 - DNA, 1436 bp, Homo sapiens
  Payload ID: 9786
  Gene Symbol: MKRN2
  Gene Name: makorin ring finger protein 2
  Uniprot ID: Q9H000
  ENST ID: ENST00000411987
  CDS Start-End: 65-1186
aaggccgaggcggcagcggctgcgagaggcggcggcacgacgacggtccctcagcccagccaccatgagcaccaagcagatcacttgcagatatgaccacacgaggccctctgctgcagctggaggtgctgtgggcaccatggcccacagtgtgccctccccagctttccacagtcctcaccctccttccgaggtcactgcatccattgtgaaaactaactcacatgaacccggaaagcgtgaaaagagaacattggttcttagagaccgaaatctctctggcatggctgaaaggaagacccagccgagcatggtgagtaatccaggcagctgcagcgacccccagcccagccccgagatgaagccgcattcctacctggatgccatcaggagtggccttgatgacgtggaggccagcagctcctacagcaacgagcagcagctgtgcccctacgcagctgctggggagtgccggtttggggatgcctgtgtctacctgcacggggaggtgtgtgaaatctgtaggctgcaagtcttgcacccattcgacccagagcagaggaaggctcatgaaaagatctgcatgttgacgttcgaacacgagatggaaaaggcctttgccttccaggcaagccaggacaaagtgtgcagtatctgcatggaagtgatcctggagaaggcctctgcttctgagaggagatttgggattctctccaattgcaatcacacgtactgtttgtcctgcatccggcagtggcggtgtgccaaacagtttgaaaacccaatcattaagtcttgtccagaatgccgtgtgatatcagagtttgtaattccaagtgtgtattgggtggaagatcagaataaaaagaacgagttgattgaagctttcaaacaggggatggggaaaaaagcctgtaaatactttgagcaaggcaaggggacctgcccatttggaagcaaatgtctttatcgccatgcttaccccgatgggcggctagcagagcctgagaaacctcggaaacagctcagttctcaaggcactgtgaggttctttaattcagtgcggctctgggatttcatcgagaaccgagaaagccggcatgtccccaacaatgaagatgtcgacatgacagagctcggggacctcttcatgcacctttctggagtggaatcatcagaaccctaaagagtagatggttgccctgcatcttgggctccatcggccgaaactttcccaagccagggtgtgcggagcttccctgtactgcagccaaggtgacgtgtgacttggatttgagtggagttgggcttagccttagtctcattcaatctccattattacagccatggggaagagtgaaagatataaagtaacctaattaaatgtatggaattgctatttttatagctgatatagttacacctcaagcccctca

SEQ ID NO: 151293 - DNA, 1679 bp, Homo sapiens
  Payload ID: 9786
  Gene Symbol: MKRN2
  Gene Name: makorin ring finger protein 2
  ENST ID: ENST00000448482
  CDS Start-End: 62-1306
gccgaggcggcagcggctgcgagaggcggcggcacgacgacggtccctcagcccagccaccatgagcaccaagcagatcacttgcaggtattttatgcatggtgtgtgtcgggaaggaagtcagtgcctattctcacatgacttggcaaacagcaaaccgtccaccatctgcaagtactaccagaagggctactgtgcctatggaactcgatatgaccacacgaggccctctgctgcagctggaggtgctgtgggcaccatggcccacagtgtgccctccccagctttccacagtcctcaccctccttccgaggtcactgcatccattgtgaaaactaactcacatgaacccggaaagcgtgaaaagagaacattggttcttagagaccgaaatctctctggcatggctgaaaggaagacccagccgagcatggtgagtaatccaggcagctgcagcgacccccagcccagccccgagatgaagccgcattcctacctggatgccatcaggagtggccttgatgacgtggaggccagcagctcctacagcaacgagcagcagctgtgcccctacgcagctgctggggagtgccggtttggggatgcctgtgtctacctgcacggggaggtgtgtgaaatctgtaggctgcaagtcttgcacccattcgacccagagcagaggaaggctcatgaaaagatctgcatgttgacgttcgaacacgagatggaaaaggcctttgccttccaggcaagccaggacaaagtgtgcagtatctgcatggaagtgatcctggagaaggcctctgcttctgagaggagatttgggattctctccaattgcaatcacacgtactgtttgtcctgcatccggcagtggcggtgtgccaaacagtttgaaaacccaatcattaagtcttgtccagaatgccgtgtgatatcagagtttgtaattccaagtgtgtattgggtggaagatcagaataaaaagaacgagttgattgaagctttcaaacaggggatggggaaaaaagcctgtaaatactttgagcaaggcaaggggacctgcccatttggaagcaaatgtctttatcgccatgcttaccccgatgggcggctagcagagcctgagaaacctcggaaacagctcagttctcaaggcactgtgaggttctttaattcagtgcggctctgggatttcatcgagaaccgagaaagccggcatgtccccaacaatgaagatgtcgacatgacagagctcggggacctcttcatgcacctttctggagtggaatcatcagaaccctaaagagtagatggttgccctgcatcttgggctccatcggccgaaactttcccaagccagggtgtgcggagcttccctgtactgcagccaaggtgacgtgtgacttggatttgagtggagttgggcttagccttagtctcattcaatctccattattacagccatggggaagagtgaaagatataaagtaacctaattaaatgtatggaattgctatttttatagctgatatagttacacctcaagcccctcaggggtaacaactaacaaacacccaaactgtttggattgattgctttaaaaaacaaacctggctcttacctttgatcttttcttccccagaaatagtaaacttgcagctgcccctaatgcagca

SEQ ID NO: 151294 - DNA, 2337 bp, Homo sapiens
  Payload ID: 9787
  Gene Symbol: MKRN3
  Gene Name: makorin ring finger protein 3
  Uniprot ID: Q13064
  ENST ID: ENST00000314520
  CDS Start-End: 100-1623
cagagaagcctccgagcgcggccgccattccgggcctcaagcccataaagaaaaaataccggagaggttctggcaccatttcggggtgccaaagcagccatggaagagcctgcagctccctcagaagcccacgaggcagccggggcccaggcaggtgctgaggcagcaagggagggtgtgtctgggccggaccttcccgtctgtgagccctccggggaatctgctgctccagattcagccctgccacatgcggcaaggggctgggcccccttccctgtagctccagtccctgcccacctccgcagaggaggcctgaggcctgccccagcctcaggaggaggagcctggcccagtccgttgccaagccgaagcagcggcatttggacaaagcagatcatctgcaggtattatatacatgggcagtgcaaggagggggagaactgtcgctattcgcacgacctttctggtcggaagatggccactgagggtggcgtttcgccgcctggggcctctgcaggtggaggccctagcacggctgcgcacatcgagcccccgactcaggaagtggcggaagcccccccggctgcatcctccctttccttgcctgtgattggctcggctgctgaaaggggtttctttgaagccgagagagacaatgcagaccgtggagctgctggaggagcaggtgtagaaagctgggcggatgccattgagtttgttccagggcagccctaccggggccgctgggttgcatctgcccccgaggctcctctacagagctcagagactgagaggaagcagatggctgtgggcagtgggttgcggttttgctattatgcttccaggggagtttgctttcgtggggagagctgtatgtacctccatggagacatatgcgacatgtgtgggctgcagaccttgcaccccatggatgctgcccagagggaagaacatatgagggcctgcattgaagcacacgagaaagatatggaactctcgtttgctgtgcagcgtggtatggacaaggtgtgtggcatctgcatggaggttgtctatgagaaggccaaccccaatgaccgccgctttggcattctttccaattgcaaccattccttctgtattaggtgtatccgcaggtggagaagtgccagacagtttgagaacaggatcgtcaagtcttgcccacagtgcagggtcacctctgaattggtcattcccagtgagttctgggtggaggaggaggaagagaagcagaaacttattcagcaatacaaggaggcaatgagcaacaaggcctgcaggtattttgcggaaggcaggggtaactgcccatttggagacacatgcttttacaagcatgaataccctgagggctggggagatgagcctcctgggccaggtggtgggtcattcagcgcatactggcatcaacttgtggagcctgtgcgaatgggagagggcaacatgctctataaaagcattaagaaggagcttgtcgtgcttcggctggccagtctgttgtttaagcggtttctttcactgagagatgagttacccttctctgaggaccagtgggacttgcttcattatgagctggaagaatatttcaatttgattctgtagcatcgtgctgtggcatgtggtctagtctgctgaggttctgtcgtctgctattgcctgttttccctgtgttgacactcttactgctttcaggggctgttgaggcagtgcttctgttttcttgtctattctgcatatctttccccctaggattatggtgattatctgtgttaaaaaataagtccttaaagttactgttttggtgaaattaatattaatgtcagcttatggcttttttttgtcatctctgttgtcaacaggattaactcagttctagtgtagtgtttactgaatttccacacttattttgaagaccctcaagagtaaatgtggcagagtgaaaggagaagttttaattgaactagtagctttgtgctataatagccttaacaaatggacccttgcagggctttgcagctgctcatctgtttgtttacagtttgttctttccctccttccccttcaagtgcacttgttaaactgtgatgaacttgtgattttgtgttttacttgaccaaaaccaagtgtatatgtttacatgtttttatcctgtttagcttgacatgaaataatttatatttggaaatatatatttaagaattatatatataaaaatatatatgtataagagttatgtatttgaaaaaaatatataaaagaatatacatcacaatataatatttatgtttatgtaataaagtaaatacagagctgaaa

SEQ ID NO: 151295 - DNA, 629 bp, Homo sapiens
  Payload ID: 9787
  Gene Symbol: MKRN3
  Gene Name: makorin ring finger protein 3
  ENST ID: ENST00000564592
  CDS Start-End: 11-559
caaagcagccatggaagagcctgcagctccctcagaagcccacgaggcagccggggcccaggcaggtgctgaggcagcaagggagggtgtgtctgggccggaccttcccgtctgtgagccctccggggaatctgctgctccagattcagccctgccacatgcggcaaggggctgggcccccttccctgtagctccagtccctgcccacctccgcagaggaggcctgaggcctgccccagcctcaggaggaggagcctggcccagtccgttgccaagccgaagcagcggcatttggacaaagcagatcatctgcaggtgtatccgcaggtggagaagtgccagacagtttgagaacaggatcgtcaagtcttgcccacagtgcagggtcacctctgaattggtcattcccagtgagttctgggtggaggaggaggaagagaagcagaaacttattcagcaatacaaggaggcaatgagcaacaaggcctgcaggttcacagctgtaaagaacttgcctggagtctcagatgagactttggactttggacttttgagttgatgctggaccaagttaagactttgttgataggatgattttatctggcaatgtgagaagaacctgagtttta

SEQ ID NO: 151296 - DNA, 1312 bp, Homo sapiens
  Payload ID: 9787
  Gene Symbol: MKRN3
  Gene Name: makorin ring finger protein 3
  ENST ID: ENST00000568252
  CDS Start-End: 67-384
gcctcaagcccataaagaaaaaataccggagaggttctggcaccatttcggggtgccaaagcagccatggaagagcctgcagctccctcagaagcccacgaggcagccggggcccaggcaggtgctgaggcagcaagggagggtgtgtctgggccggaccttcccgtctgtgagccctccggggaatctgctgctccagattcagccctgccacatgcggcaaggggctgggcccccttccctgtagctccagtccctgcccacctccgcagaggaggcctgaggcctgccccagcctcaggaggaggagcctggcccagtccgttgccaagccgaagcagcggcatttggacaaagcagatcatctgcagagatatttgttgagtgatgtttcaggctggaagcggtgagccactgacagggatcagagaattccccacagaatttggcagtcacatgcatggatttagaaagacaaagttggaaatgaattgttgcagctaatttctccctcaagacattgtctacattctgaagctagatctggtggcagaggagactaaggagctcagtatttccacatagtaacaacaaacattctaaaaagaaacaagagaacaatcttacttacaacagcttcaaaaaataaaatatttagaaataagtttaaccaagaaggtgaaagacctgtacactgaaaaatgttaataacaaaaattatagaagacacaaataaattggaagatattctgtgttcatagattggaagaataatgttgctaaaatgtccatactaccccaaatgacttatagactcaaagcaatttctaacaaaattgtaatgtaattattcatagtaacagaaaaaaatataaaattaatgtggaaccacaacaaactctgaatagccaaaggaatcatgagtaagaagatgaaagctggaggcaccaaccacatgcatgatttaaaactacactacaaagcaatagtaattaaaacagtgtgatactggcatgaaaatagactcgttggctgggtgcagtggctcacgcctgtaatcccagcacgttgggagtctgaggcaggaagatcatgaggttaggagtttgagaccagcctgaccaacatggtgaaagcccgtctctacaaaaaatacaaaaattagccaggcatggtggcacatgccggtaatcccagctactcaggcaactgaggcaggagaattgcttgaacccgggaggcagaggctgcagtgagcctagattacaccactgcactcccgcctgggtgacagagcaagactctatctcaa

SEQ ID NO: 151297 - DNA, 470 bp, Homo sapiens
  Payload ID: 9787
  Gene Symbol: MKRN3
  Gene Name: makorin ring finger protein 3
  ENST ID: ENST00000570112
  CDS Start-End: 106-192
ttcccccagagaagcctccgagcgcggccgccattccgggcctcaagcccataaagaaaaaataccggagaggttctggcaccatttcggggtgccaaagcagccatggaagagcctgcagctccctcagaagcccacgaggcagccggggcccaggtgtatccgcaggtggagaagtgccagacagtttgagaacaggatcgtcaagtcttgcccacagtgcagggtcacctctgaattggtcattcccagtgagttctgggtggaggaggaggaagagaagcagaaacttattcagcaatacaaggaggcaatgagcaacaaggcctgcaggttcacagctgtaaagaacttgcctggagtctcagatgagactttggactttggacttttgagttgatgctggaccaagttaagactttgttgataggatgattttatctggcaatgtgagaagaacctgagtttta

SEQ ID NO: 151298 - DNA, 831 bp, Homo sapiens
  Payload ID: 9788
  Gene Symbol: MAL
  Gene Name: mal, T-cell differentiation protein
  Uniprot ID: P21145
  ENST ID: ENST00000354078
  CDS Start-End: 1-294
atggcccccgcagcggcgacggggggcagcaccctgcccagtggcttctcggtcttcaccaccttgcccgacttgctcttcatctttgagtttgacgcagcctaccactgcaccgctgccctcttttacctcagcgcctcagtcctggaggccctggccaccatcacgatgcaagacggcttcacctacaggcactaccatgaaaacattgctgccgtggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaa

SEQ ID NO: 151299 - DNA, 873 bp, Homo sapiens
  Payload ID: 9788
  Gene Symbol: MAL
  Gene Name: mal, T-cell differentiation protein
  Uniprot ID: P21145
  ENST ID: ENST00000353004
  CDS Start-End: 1-336
atggcccccgcagcggcgacggggggcagcaccctgcccagtggcttctcggtcttcaccaccttgcccgacttgctcttcatctttgagtttatcttcgggggcctggtgtggatcctggtggcctcctccctggtgccctggcccctggtccagggctgggtgatgttcgtgtctgtgttctgcttcgtggccaccaccaccttgatcatcctgtacataattggagcccacggtggagagacttcctgggtcaccttggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaa

SEQ ID NO: 151300 - DNA, 1112 bp, Homo sapiens
  Payload ID: 9788
  Gene Symbol: MAL
  Gene Name: mal, T-cell differentiation protein
  Uniprot ID: P21145
  ENST ID: ENST00000309988
  CDS Start-End: 110-571
cccgcgcgcgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttatcttcgggggcctggtgtggatcctggtggcctcctccctggtgccctggcccctggtccagggctgggtgatgttcgtgtctgtgttctgcttcgtggccaccaccaccttgatcatcctgtacataattggagcccacggtggagagacttcctgggtcaccttggacgcagcctaccactgcaccgctgccctcttttacctcagcgcctcagtcctggaggccctggccaccatcacgatgcaagacggcttcacctacaggcactaccatgaaaacattgctgccgtggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaataca

SEQ ID NO: 151301 - DNA, 705 bp, Homo sapiens
  Payload ID: 9788
  Gene Symbol: MAL
  Gene Name: mal, T-cell differentiation protein
  Uniprot ID: P21145
  ENST ID: ENST00000349807
  CDS Start-End: 1-168
atggcccccgcagcggcgacggggggcagcaccctgcccagtggcttctcggtcttcaccaccttgcccgacttgctcttcatctttgagtttgtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaa

SEQ ID NO: 151302 - DNA, 2818 bp, Homo sapiens
  Payload ID: 9789
  Gene Symbol: MAL2
  Gene Name: mal, T-cell differentiation protein 2 (gene/pseudogene)
  Uniprot ID: Q969L2
  ENST ID: ENST00000614891
  CDS Start-End: 103-633
agcccgcggagctgagcggcggcggcggcggcggcaggagcccgggaggcggaggcgggaggcggcggcggcgcgcggagacgcagcagcggcagcggcagcatgtcggccggcggagcgtcagtcccgccgcccccgaaccccgccgtgtccttcccgccgccccgggtcaccctgcccgccggccccgacatcctgcggacctactcgggcgccttcgtctgcctggagattctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcataaaaaattagtatcccttttgtttggttgctgagtcacctgaaccttaattttaattggtaattacagcccctaaaaaaaacacatttcaaataggcttcccactaaactctatattttagtgtaaaccaggaattggcacactttttttagaatgggccagatggtaaatatttatgcttcacggtccatacagtctctgtcacaactattcagttctgctagtatagcgtgaaagcagctatacacaatacagaaatgaatgagtgtggttatgttctaataaaacttatttataaaaacaaggggaggctgggtttagcctgtgggccatagtttgtcaaccactggtgtaaaaccttagttatatatgatctgcattttcttgaactgatcattgaaaacttataaacctaacagaaaagccacataatatttagtgtcattatgcaataatcacattgcctttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttgataa

SEQ ID NO: 151303 - DNA, 578 bp, Homo sapiens
  Payload ID: 9789
  Gene Symbol: MAL2
  Gene Name: mal, T-cell differentiation protein 2 (gene/pseudogene)
  ENST ID: ENST00000534619
  CDS Start-End: 218-544
ataagcaccccactttttaagtgtgactggtgacctcgattttaccttctgagtcacagcaccaagacctgtgtatctgtcaaactgagcacagtgggcgagggcgcgctgtgagagctggggagaagacaggtggagagcacagctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagttt

SEQ ID NO: 151304 - DNA, 573 bp, Homo sapiens
  Payload ID: 9789
  Gene Symbol: MAL2
  Gene Name: mal, T-cell differentiation protein 2 (gene/pseudogene)
  ENST ID: ENST00000522112
  CDS Start-End: 207-533
agattccatgggcgtaggaccctccgagccagggcaagaagttgcaggaaaaatggcttctagcagtggaacttcctcatacacgtgatctgtttctgattagagaactgcaggaggtgaaaattgggttcaagctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttg

SEQ ID NO: 151305 - DNA, 892 bp, Homo sapiens
  Payload ID: 9789
  Gene Symbol: MAL2
  Gene Name: mal, T-cell differentiation protein 2 (gene/pseudogene)
  ENST ID: ENST00000531508
  CDS Start-End: 406-732
gaacattggggacgtggaggaaagaaaggtgttggggctcagaggcgcctttagaaacccagggcatggccaggggccgcgcttggccggagcgagctcctggctctcggcctcgcctgttgctaacctgccattttgttgggtggtgcaaaggtgtagccgatgactgggtgacctggtggctgccacgctgtggaaagtgggggcgggaggcaacaggaagaggaagagggctgaggacttgaacatgctttttccccactcacccttgccatcattagtggcctttggattggaaagaggagctgggcaggaggcagggcaaggagaaagctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatgg

SEQ ID NO: 151306 - DNA, 3061 bp, Homo sapiens
  Payload ID: 9790
  Gene Symbol: MALL
  Gene Name: mal, T-cell differentiation protein-like
  Uniprot ID: Q13021
  ENST ID: ENST00000272462
  CDS Start-End: 775-1236
actagaggcagcagccagccagcccagcccttctctggtgcctgccggtgtggtcctctcccagagactggggggccttcatctgccccatgaggaaaagaggagtggaggaccatggaaagggatccagaaaaagaaggaaacaccaagtcccaggggcatgagctggaagggagggctgctcctcccaggggaggctggggactgagagctgtccccaagagtggaaaaggagggagctgggcaagacccagcattgttagtaaccagctctgtggtcttgacttgacctcactgattctcagtctcctcacttggaaaagggcaaaacagccacgtgcaggccgtggtgggcacccgggctgtctgcagatagcttggctcattgttggtcctcagtacgcagccctcgtagccaagcagcttgggcctacactctgggcccaggggagtggctgtcgctggcatcccctggaataacatgctccgggggtcaaagattccttagctggaaaggtctaggaggagactcccgctctgctccctcctgcaccagcgctgtgccccccgccggccaggcagagccatccgatgccgctgggccgcccactgaggatctgctggctgcagcgagtggaaggacctgctcggctggaacgttttttttttttttccctcccaggcgacgtccgatgggtgtgtcgggcaggaggtgatatttgacaggctgcgcgcgggcgagctgccgcggagcacccggcaggggctgacagcatggcctcgcccgacccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccgtgcccggctaatttagttgtatttttagtagagatggggtttcaccgtattagccaggatggtctcgatctcctgacctcgtgatccgcccgcctcggcctcccaaagtgctgggattacaggcgtgagccaccgcgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatttgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgctcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatacttttttttttttttttttttttgcaacctgataccttgaaaagcttctatgtgtctctccttttgttgcctggcagctgtctaggatgatcactgattactatttactaagtagccacatgcaaataaaagttgtttggtaaaaagga

SEQ ID NO: 151307 - DNA, 580 bp, Homo sapiens
  Payload ID: 9790
  Gene Symbol: MALL
  Gene Name: mal, T-cell differentiation protein-like
  ENST ID: ENST00000424988
  CDS Start-End: 30-392
ccgcggagcacccggcaggggctgacagcatggcctcgcccgacccgcccgccaccagctacgccccgtccgacgtgccctcgggggtcgcgctgttcctcaccatccctttcgccttcttcctgcccgagctgggcatcattactcaggcagcgtctgtctcagaacctcagtgtgtgatcccggcccctgcagcagcccctctcccacccatgaggggcttccagctgctctgtgcagatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttca

SEQ ID NO: 151308 - DNA, 1070 bp, Homo sapiens
  Payload ID: 9790
  Gene Symbol: MALL
  Gene Name: mal, T-cell differentiation protein-like
  ENST ID: ENST00000427178
  CDS Start-End: 231-398
ctcctgcaccagcgctgtgccccccgccggccaggcagagccatccgatgccgctgggccgcccactgaggatctgctggctgcagcgagtggaaggacctgctcggctggaacgttttttttttttttccctcccaggcgacgtccgatgggtgtgtcgggcaggaggtgatatttgacaggctgcgcgcgggcgagctgccgcggagcacccggcaggggctgacagcatggcctcgcccgacccgcccgccaccagctacgccccgtccgacgtgccctcgggggtcgcgctgttcctcaccatccctttcgccttcttcctgcccgagctgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccgtgcccggctaatttagttgtatttttagtagagatggggtttcaccgtattagccaggatggtctcgatctcctgacctcgtgatccgcccgcctcggcctccc

SEQ ID NO: 151309 - DNA, 1650 bp, Homo sapiens
  Payload ID: 9791
  Gene Symbol: MDH1
  Gene Name: malate dehydrogenase 1, NAD (soluble)
  Uniprot ID: P40925
  ENST ID: ENST00000233114
  CDS Start-End: 436-1440
gcgcgtgggggtgatgtcgctaaggggtgattctcccctccctagagttacacacgctatctctcccgccaattgccgggctccatcaggcaggtcctttcctcctgagcccaaaccatccgtttgttgtcgtcctccaatcacaggggctcatcctcagggactactttgcaatcggcgcagagcgcagtgagaagagcttgaaaaaaacctctggtatcgggaagtgtagttcaacacttgaaggaaatgctttggagattgcgccacaaccagggcagcgtaaactacagttcccagagagcgccgcgtcgggagcggagccttttctcgctaacaccgctcgccctctccgagtcagttccgcggtagaggtgacctgactctctgaggctcattttgcagttgttgaaattgtccccgcagttttcaatcatgtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaaaacaacacattttaaagattacgtgcttcttggtacaggtttgtgaatgacagtttatcgtcatgctgttagtgtgcattctaaataaatatatattcaaatgaaa

SEQ ID NO: 151310 - DNA, 808 bp, Homo sapiens
  Payload ID: 9791
  Gene Symbol: MDH1
  Gene Name: malate dehydrogenase 1, NAD (soluble)
  ENST ID: ENST00000409476
  CDS Start-End: 72-704
cgcggtagaggtgacctgactctctgaggctcattttgcagttgttgaaattgtccccgcagttttcaatcatggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaa

SEQ ID NO: 151311 - DNA, 700 bp, Homo sapiens
  Payload ID: 9791
  Gene Symbol: MDH1
  Gene Name: malate dehydrogenase 1, NAD (soluble)
  ENST ID: ENST00000409908
  CDS Start-End: 87-596
tctccgagtcagttccgcggtagaggtgacctgactctctgaggctcattttgcagttgttgaaattgtccccgcagttttcaatcatgattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaa

SEQ ID NO: 151312 - DNA, 680 bp, Homo sapiens
  Payload ID: 9791
  Gene Symbol: MDH1
  Gene Name: malate dehydrogenase 1, NAD (soluble)
  ENST ID: ENST00000436321
  CDS Start-End: 322-680
ggtgacctgactctctgaggctcattttgcagttgttgaaattgtccccgcagttttcaatcatgaatgtggagaaatgtttgaatgaattggaaatttcccagaacctgaaaagacacgttttcaaggcaagggcattactctctctgcctgtctaacggggccagtggagacagctactaatttccatctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagc

SEQ ID NO: 151313 - DNA, 785 bp, Homo sapiens
  Payload ID: 9791
  Gene Symbol: MDH1
  Gene Name: malate dehydrogenase 1, NAD (soluble)
  ENST ID: ENST00000442225
  CDS Start-End: 584-785
gagtcagttccgcggtagaggtgacctgactctctgaggctcattttgcagttgttgaaattgtccccgcagttttcaatcatggagtttcgctcttgttgcccaggctggaatacaatggcacgatctccactcactcaacctctgcctcccgggttcaagtgattcacctgcctcagccttccaaatagctgggagatgcctgccaccacacccagctaattctgtatttttagtagagacggggtttctccatattggtcaggctggtctcaaactcccaacctcaggtgatccgcctgcctcagcctcccaaagtgctgagattacaggcatgagccaccatccctggcctgacacttcttttttgaaatttttttttttctttgacttctatgagtgagtaccaaattgctgagtgctgctaactttcagagcttagtgtcagaagcttgaaagaagccttcgaggctatccatccttgtttcgtctcagagacgtgactctcatctggaagaaggaactttaagtaaaaagaaaccaaacacttctgggcttagtcacatcagtggaccatttctccatgcagtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaag

SEQ ID NO: 151314 - DNA, 573 bp, Homo sapiens
  Payload ID: 9791
  Gene Symbol: MDH1
  Gene Name: malate dehydrogenase 1, NAD (soluble)
  ENST ID: ENST00000421012
  CDS Start-End: 4-267
aaaatgcgacgctgcagctattttccaaaggacgttacggtgtttgataaggacgataagtctgaaccaatcagagtccttgtgactggagcagctggtcaaattgcatattcactgctgtacagtattggaaatggatctgtctttggtaaagatcagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaa

SEQ ID NO: 151315 - DNA, 575 bp, Homo sapiens
  Payload ID: 9791
  Gene Symbol: MDH1
  Gene Name: malate dehydrogenase 1, NAD (soluble)
  ENST ID: ENST00000454035
  CDS Start-End: 234-575
tgaggctcattttgcagttgttgaaattgtccccgcagttttcaatcatgtgagtaccaaattgctgagtgctgctaactttcagagcttagtgtcagaagcttgaaagaagccttcgaggctatccatccttgtttcgtctcagagacgtgactctcatctggaagaaggaactttaagtaaaaagaaaccaaacacttctgggcttagtcacatcagtggaccatttctccatgcagtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggt

SEQ ID NO: 151316 - DNA, 844 bp, Homo sapiens
  Payload ID: 9791
  Gene Symbol: MDH1
  Gene Name: malate dehydrogenase 1, NAD (soluble)
  ENST ID: ENST00000432309
  CDS Start-End: 178-844
ccttcgcgccctttggcaagctcggactcatcttctggggattgccgcagtgacccagtaatgggaagggattgatttccaccttgcggggtatggggcgctcttaggaggactctggagaagtagttgtcctgggagaggagcgatcttaatcctgctgcatgacgggaggacaaaatgcgacgctgcagctattttccaaaggacgttacggtgtttgataaggacgataagtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaa

SEQ ID NO: 151317 - DNA, 1443 bp, Homo sapiens
  Payload ID: 9791
  Gene Symbol: MDH1
  Gene Name: malate dehydrogenase 1, NAD (soluble)
  Uniprot ID: P40925
  ENST ID: ENST00000539945
  CDS Start-End: 178-1236
ccttcgcgccctttggcaagctcggactcatcttctggggattgccgcagtgacccagtaatgggaagggattgatttccaccttgcggggtatggggcgctcttaggaggactctggagaagtagttgtcctgggagaggagcgatcttaatcctgctgcatgacgggaggacaaaatgcgacgctgcagctattttccaaaggacgttacggtgtttgataaggacgataagtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaaaacaacacattttaaagattacgtgcttcttggtacaggtttgtgaatgacagtttatcgtcatgctgttagtgtgcattctaaataaatatatattcaaatg

SEQ ID NO: 151318 - DNA, 1346 bp, Homo sapiens
  Payload ID: 9791
  Gene Symbol: MDH1
  Gene Name: malate dehydrogenase 1, NAD (soluble)
  Uniprot ID: P40925
  ENST ID: ENST00000544381
  CDS Start-End: 402-1139
ccttcgcgccctttggcaagctcggactcatcttctggggattgccgcagtgacccagtaatgggaagggattgatttccaccttgcggggtatggggcgctcttaggaggactctggagaagtagttgtcctgggagaggagcgatcttaatcctgctgcatgacgggaggacaaaatgcgacgctgcagctattttccaaaggacgttacggtgtttgataaggacgataagtctgaaccaatcagagtccttgtgactggagcagctggtcaaattgcatattcactgctgtacagtattggaaatggatctgtctttggtaaagatcagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaaaacaacacattttaaagattacgtgcttcttggtacaggtttgtgaatgacagtttatcgtcatgctgttagtgtgcattctaaataaatatatattcaaatg

SEQ ID NO: 151319 - DNA, 2553 bp, Homo sapiens
  Payload ID: 9792
  Gene Symbol: MDH1B
  Gene Name: malate dehydrogenase 1B, NAD (soluble)
  Uniprot ID: Q5I0G3
  ENST ID: ENST00000374412
  CDS Start-End: 277-1833
atgttcgcggctgtagctgaaggacttacttgaagaaagtttaccaaggagaatgactaatttccctgcatacaggagtggggctcggggataccacagagcttataagggcgatgtttgatcgtgtatcgcaacgtaacccattcaggtcctaactttaaacacctaacctctgctgggcgccagactttgtagtgcgcctgcgccttgcccttggctgcgtggttgccaggaaaccgcgaagccgcggtccctgcctctgagtctctctcgaccatggccaaattcgtcatcgcgggtagagcagattgtccatattatgctaaaacagaacttgtggcagactatttacaaaagaatcttcctgattttcggatacataaaatcacacaacgtcctgaggtttgggaggattggctaaaagatgtgtgtgaaaagaataagtggagtcacaagaattcccctatcatctggagagagctgttggatcgtggaggaaagggtttgcttttgggaggatataatgagttcctggagcatgctcagctttactatgatgtcacctctagcatgacgactgaactgatgatggtaattgctcaagagaacctgggggcacatatagaaaaagagcaggaggaagaagccctgaaaacttgcatcaaccccttgcaggtctggatcaccagtgcctctgctcctgcctgctacaacctaattcccatattgacgagtggcgaagtgtttgggatgcatacagaaattagcataactctatttgacaacaagcaggcggaagaacatctcaaaagccttgtggtggagacccaagacctggcatctcccgtcctgcgcagtgtctccatctgcacgaaggtggaggaggccttccgccaggcccacgtcattgtggtgctggatgacagcaccaacaaggaggtgttcactctggaggactgcctccgaagcagggtgcctctctgcaggctctatgggtacctgatagagaaaaatgctcatgagtctgtcagagtcatcgtgggagggagaacctttgtaaacctgaagacagttttactcatgagatatgccccacgcattgcacacaacattattgctgtggcgctgggggtggaaggtgaagcgaaagccatactggccagaaaactgaagacagctccttcatacattaaagacgtgatcatttggggtaatatcagtggaaataattacgttgatctgagaaaaacaagggtgtacagatatgagagtgccatttggggacctcttcattattcacgccctgttttaaacttgatttttgacagtgagtgggtaaaaagagaatttgtggcaattcttaaaaacttgaccaccacaggaagacaatttggaggcattttggctgcacacagtatagccactacactgaaatactggtaccatggctcaccacctggggagattgtatctttaggaatattgagtgaaggccagtttggtattccgaaagggatcgtcttttctatgcctgtgaaatttgagaatggaacttgggtggttcttacagatctcaaagatgttgaaataagtgaacaaataatgacccgaatgacaagtgatctaattcaggagaaacttgttgcacttggagacaagatacattttcagccataccaatcaggacataaagatctggtccctgatgaagaaaaaaatctagctatgtcagatgcagcagagtttccaaatcagattcctcaaaccacctttgaaaagccacagagtcttgagttcctaaatgaatttgaaggcaaaaccgtggaatcctaacagatcaaattggatgaaatatataattacttgatagcacaataaacatagaaagaatttatatgaatgtctatatttaaggaagaataatttgaaagatttatgtcagtcttagataataccatgcaaggcaattaaatcactgtgacagcacagaggtcagagttccgtcattttgcattacttgtatccactcatgtttgtttcataataattgcattttcttagaactattttggtgtcaaatgctattttttatattacattaaaatagagttgtcagtcattgcatctgcccatacatcttctgagagaacctgcttccttccatcagccatacctaagacctgcacctaagtggccatgtttgctcaaatgtcctcatcaccttggcctcaactaattaggccaaacagatgtacttcactcaaggagaaccaatcatattttctctctgtctctcaaaaaaaaattgaactgagaccagtgagtaagttggtgtctgggtcaggttaatggtggtgaactatgtgcctgtgagctcttcagagctggttgggttcaccaccttcataagacctgcctctgtaccatttttccttgagtgtgctttgtataaaggtctgtacaataaatcacacttttttaaagcttagattgaataggtttctgctccttgacaagagatatggcctgaataaaatgaattttgaaagaaaa

SEQ ID NO: 151320 - DNA, 1795 bp, Homo sapiens
  Payload ID: 9792
  Gene Symbol: MDH1B
  Gene Name: malate dehydrogenase 1B, NAD (soluble)
  Uniprot ID: Q5I0G3
  ENST ID: ENST00000454776
  CDS Start-End: 16-1569
gagtctctctcgaccatggccaaattcgtcatcgcgggtagagcagattgtccatattatgctaaaacagaacttgtggcagactatttacaaaagaatcttcctgattttcggatacataaaatcacacaacgtcctgaggtttgggaggattggctaaaagatgtgtgtgaaaagaataagtggagtcacaagaattcccctatcatctggagagagctgttggatcgtggaggaaagggtttgcttttgggaggatataatgagttcctggagcatgctcagctttactatgatgtcacctctagcatgacgactgaactgatgatggtaattgctcaagagaacctgggggcacatatagaaaaagagcaggaggaagaagccctgaaaacttgcatcaaccccttgcaggtctggatcaccagtgcctctgctcctgcctgctacaacctaattcccatattgacgagtggcgaagtgtttgggatgcatacagaaattagcataactctatttgacaacaagcaggcggaagaacatctcaaaagccttgtggtggagacccaagacctggcatctcccgtcctgcgcagtgtctccatctgcacgaaggtggaggaggccttccgccaggcccacgtcattgtggtgctggatgacagcaccaacaaggaggtgttcactctggaggactgcctccgaagcagggtgcctctctgcaggctctatgggtacctgatagagaaaaatgctcatgagtctgtcagagtcatcgtgggagggagaacctttgtaaacctgaagacagttttactcatgagatatgccccacgcattgcacacaacattattgctgtggcgctgggggtggaaggtgaagcgaaagccatactggccagaaaactgaagacagctccttcatacattaaagacgtgatcatttggggtaatatcagtggaaataattacgttgatctgagaaaaacaagggtgtacagatatgagagtgccatttggggacctcttcattattcacgccctgttttaaacttgatttttgacagtgagtgggtaaaaagagaatttgtggcaattcttaaaaacttgaccaccacaggaagacaatttggaggcattttggctgcacacagtatagccactacactgaaatactggtaccatggctcaccacctggggagattgtatctttaggaatattgagtgaaggccagtttggtattccgaaagggatcgtcttttctatgcctgtgaaatttgagaatggaacttgggtggttcttacagatctcaaagatgttgaaataagtgaacaaataatgacccgaatgacaagtgatctaattcaggagaaacttgttgcacttggagacaagatacattttcagccataccaatcaggacataaagatctggtccctgatgaagaaaaaaatctagctatgtcagatgcagagtttccaaatcagattcctcaaaccacctttgaaaagccacagagtcttgagttcctaaatgaatttgaaggcaaaaccgtggaatcctaacagatcaaattggatgaaatatataattacttgatagcacaataaacatagaaagaatttatatgaatgtctatatttaaggaagaataatttgaaagatttatgtcagtcttagataataccatgcaaggcaattaaatcactgtgacagcacagaggtcagagttccgtcattttgcattacttgtatccactcatgtttgtttcataataattgcattttctt

SEQ ID NO: 151321 - DNA, 1874 bp, Homo sapiens
  Payload ID: 9792
  Gene Symbol: MDH1B
  Gene Name: malate dehydrogenase 1B, NAD (soluble)
  Uniprot ID: Q5I0G3
  ENST ID: ENST00000432911
  CDS Start-End: 24-875
ctgcctctgagtctctctcgaccatggccaaattcgtcatcgcgggtagagcagattgtccatattatgctaaaacagaacttgtggcagactatttacaaaagaatcttcctgattttcggatacataaaatcacacaacgtcctgaggtttgggaggattggctaaaagatgtgtgtgaaaagaataagtggagtcacaagaattcccctatcatctggagagagctgttggatcgtggaggaaagggtttgcttttgggaggatataatgagttcctggagcatgctcagctttactatgatgtcacctctagcatgacgactgaactgatgatggtaattgctcaagagaacctgggggcacatatagaaaaagagcaggaggaagaagccctgaaaacttgcatcaaccccttgcaggtctggatcaccagtgagtgggtaaaaagagaatttgtggcaattcttaaaaacttgaccaccacaggaagacaatttggaggcattttggctgcacacagtatagccactacactgaaatactggtaccatggctcaccacctggggagattgtatctttaggaatattgagtgaaggccagtttggtattccgaaagggatcgtcttttctatgcctgtgaaatttgagaatggaacttgggtggttcttacagatctcaaagatgttgaaataagtgaacaaataatgacccgaatgacaagtgatctaattcaggagaaacttgttgcacttggagacaagatacattttcagccataccaatcagacacacccaggatcaatactttgcatccttcaatccaatcaagttggcactcggtattaaccatcacaattagaaaaagataagtattatttcatgtatttttttgtttcattaatatgtacacaaatgtacacattggactataatgtaaaatgtgtcttttattgtgggtcatagtcactgaagtttgaaaaacattgactcagaacatctcatgacctagttaggttgttggttatattctaaatccagcatgttttatttaattttgatttcaggacataaagatctggtccctgatgaagaaaaaaatctagctatgtcagatgcagcagagtttccaaatcagattcctcaaaccacctttgaaaagccacagagtcttgagttcctaaatgaatttgaaggcaaaaccgtggaatcctaacagatcaaattggatgaaatatataattacttgatagcacaataaacatagaaagaatttatatgaatgtctatatttaaggaagaataatttgaaagatttatgtcagtcttagataataccatgcaaggcaattaaatcactgtgacagcacagaggtcagagttccgtcattttgcattacttgtatccactcatgtttgtttcataataattgcattttcttagaactattttggtgtcaaatgctattttttatattacattaaaatagagttgtcagtcattgcatctgcccatacatcttctgagagaacctgcttccttccatcagccatacctaagacctgcacctaagtggccatgtttgctcaaatgtcctcatcaccttggcctcaactaattaggccaaacagatgtacttcactcaaggagaaccaatcatattttctctctgtctctcaaaaaaaaattgaactgagaccagtgagtaagttggtgtctgggtcaggttaatggtggtgaactatgtgcctgtgagctcttcagagctggttgggttcaccaccttcataagacctgcctctgtaccatttttccttgagtgtgctttgtataaaggtctgtacaataaatcacacttttttaaagctta

SEQ ID NO: 151322 - DNA, 911 bp, Homo sapiens
  Payload ID: 9792
  Gene Symbol: MDH1B
  Gene Name: malate dehydrogenase 1B, NAD (soluble)
  ENST ID: ENST00000436472
  CDS Start-End: 37-438
gaagccgcggtccctgcctctgagtctctctcgaccatggccaaattcgtcatcgcgggtagagcagattgtccatattatgctaaaacagaacttgtggcagactatttacaaaagaatcttcctgattttcggatacataaaatcacacaacgtcctgaggtttgggaggattggctaaaagatgtgtgtgaaaagaataagtggagtcacaagaattcccctatcatctggagagagctgttggatcgtggaggaaagggtttgcttttgggaggatataatgagttcctggagcatgctcagctttactatgatgtcacctctagcatgacgactgaactgatgatggtaattgctcaagagaacctgggggcacatatagaaaaagagcaggaggaagaagccctgaaaacttgcatcaaccccttgcagtgagtgggtaaaaagagaatttgtggcaattcttaaaaacttgaccaccacaggaagacaatttggaggcattttggctgcacacagtatagccactacactgaaatactggtaccatggctcaccacctggggagattgtatctttaggaatattgagtgaaggccagtttggtattccgaaagggatcgtcttttctatgcctgtgaaatttgagaatggaacttgggtggttcttacagatctcaaagatgttgaaataagtgaacaaataatgacccgaatgacaagtgatctaattcaggagaaacttgttgcacttggagacaagatacattttcagccataccaatcaggacataaagatctggtccctgatgaagaaaaaaatctagctatgtcagatgcagcagagtttccaaatcagattcctcaaaccacctttgaaaagccacagagtcttgagttcctaaatg

SEQ ID NO: 151323 - DNA, 1757 bp, Homo sapiens
  Payload ID: 9792
  Gene Symbol: MDH1B
  Gene Name: malate dehydrogenase 1B, NAD (soluble)
  ENST ID: ENST00000449792
  CDS Start-End: 237-1499
gtggttgccaggaaaccgcgaagccgcggtccctgcctctgagtctctctcgaccatggccaaattcgtcatcgcgggattggctaaaagatgtgtgtgaaaagaataagtggagtcacaagaattcccctatcatctggagagagctgttggatcgtggaggaaagggtttgcttttgggaggatataatgagttcctggagcatgctcagctttactatgatgtcacctctagcatgacgactgaactgatgatggtaattgctcaagagaacctgggggcacatatagaaaaagagcaggaggaagaagccctgaaaacttgcatcaaccccttgcaggtctggatcaccagtgcctctgctcctgcctgctacaacctaattcccatattgacgagtggcgaagtgtttgggatgcatacagaaattagcataactctatttgacaacaagcaggcggaagaacatctcaaaagccttgtggtggagacccaagacctggcatctcccgtcctgcgcagtgtctccatctgcacgaaggtggaggaggccttccgccaggcccacgtcattgtggtgctggatgacagcaccaacaaggaggtgttcactctggaggactgcctccgaagcagggtgcctctctgcaggctctatgggtacctgatagagaaaaatgctcatgagtctgtcagagtcatcgtgggagggagaacctttgtaaacctgaagacagttttactcatgagatatgccccacgcattgcacacaacattattgctgtggcgctgggggtggaaggtgaagcgaaagccatactggccagaaaactgaagacagctccttcatacattaaagacgtgatcatttggggtaatatcagtggaaataattacgttgatctgagaaaaacaagggtgtacagatatgagagtgccatttggggacctcttcattattcacgccctgttttaaacttgatttttgacagtgagtgggtaaaaagagaatttgtggcaattcttaaaaacttgaccaccacaggaagacaatttggaggcattttggctgcacacagtatagccactacactgaaatactggtaccatggctcaccacctggggagattgtatctttaggaatattgagtgaaggccagtttggtattccgaaagggatcgtcttttctatgcctgtgaaatttgagaatggaacttgggtggttcttacagatctcaaagatgttgaaataagtgaacaaataatgacccgaatgacaagtgatctaattcaggagaaacttgttgcacttggagacaagatacattttcagccataccaatcaggacataaagatctggtccctgatgaagaaaaaaatctagctatgtcagatgcagcagagtttccaaatcagattcctcaaaccacctttgaaaagccacagagtcttgagttcctaaatgaatttgaaggcaaaaccgtggaatcctaacagatcaaattggatgaaatatataattacttgatagcacaataaacatagaaagaatttatatgaatgtctatatttaaggaagaataatttgaaagatttatgtcagtcttagataataccatgcaaggcaattaaatcactgtgacagcacagaggtcagagttccgtcattttgcattacttgtatccactcatgtttgtttcataataattgcattttcttagaactattttggtgtcaaatgctatttttta

SEQ ID NO: 151324 - DNA, 2209 bp, Homo sapiens
  Payload ID: 9793
  Gene Symbol: MDH2
  Gene Name: malate dehydrogenase 2, NAD (mitochondrial)
  Uniprot ID: P40926
  ENST ID: ENST00000315758
  CDS Start-End: 95-1111
agagagcaggcgctgggcagtgtggaggtcgttggagtcacttccccgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaa

SEQ ID NO: 151325 - DNA, 1548 bp, Homo sapiens
  Payload ID: 9793
  Gene Symbol: MDH2
  Gene Name: malate dehydrogenase 2, NAD (mitochondrial)
  Uniprot ID: P40926
  ENST ID: ENST00000432020
  CDS Start-End: 1-891
atgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccgggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagccc

SEQ ID NO: 151326 - DNA, 2020 bp, Homo sapiens
  Payload ID: 9793
  Gene Symbol: MDH2
  Gene Name: malate dehydrogenase 2, NAD (mitochondrial)
  ENST ID: ENST00000443006
  CDS Start-End: 229-924
agtgtggaggtcgttggagtcacttccccgtcaccagctcctgtgcctgccagtcggtgcccctcccgctccagccatgctctccgccctcgcccggcctgccagcgctgctctccgccgcagcttcagcacctcggcccaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggt

SEQ ID NO: 151327 - DNA, 648 bp, Homo sapiens
  Payload ID: 9793
  Gene Symbol: MDH2
  Gene Name: malate dehydrogenase 2, NAD (mitochondrial)
  ENST ID: ENST00000461263
  CDS Start-End: 111-197
actctcgcgaggccccagagagcaggcgctgggcagtgtggaggtcgttggagtcacttccccgtcaccagctcctgtgcctgccagtcggtgcccctcccgctccagccatgctctccgccctcgcccggcctgccagcgctgctctccgccgcagcttcagcacctcggcccagcgttccattgctttgacgtagctaatctccttgcagcatccgtgtgagttgtgcgtgaataaaagaaatcgtatacttcctaattccatagtatggacaaaccgaggctagagaactgggccagggttacagtcatttggccagaggattagaattcagcgcttctgacctgaagacggcttcctcttaacctttttggaggatctctcctgctgtgggcggactgagcctgccgccaggtgtcttaacagtgcttgacttggcccgcgaccacttaagcctaggagcctaggctatttttagccatcttctagaatggtggttcttaaactctgcagtgtgtcagaatcaccagaaagctaataaaaaacagacgtctgggttcattgaagaagcttaagactgcgggggggggggggggggtccgcatttttaccaggtgaatctaattaaacctaattttgagaaccca

SEQ ID NO: 151328 - DNA, 3984 bp, Homo sapiens
  Payload ID: 9794
  Gene Symbol: MAK
  Gene Name: male germ cell-associated kinase
  Uniprot ID: P20794
  ENST ID: ENST00000313243
  CDS Start-End: 384-2255
gcaggcgcggacaggtaatccccagcgggctgcagggccaccaccctctgtccgacccagccggagcccgacctgcgaggctggccgggcatgtcccctcggcgccctgtgctaccagggccaatctccgcccggagaccggtccctgacgccgggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcatgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacagaaagattgcaattatttgtttttctactttgaagctatgggagcgatggtaatttcaatcttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcattaaaaaaaatatggctaa

SEQ ID NO: 151329 - DNA, 3941 bp, Homo sapiens
  Payload ID: 9794
  Gene Symbol: MAK
  Gene Name: male germ cell-associated kinase
  Uniprot ID: P20794
  ENST ID: ENST00000354489
  CDS Start-End: 283-2229
tcctaggagatgaaacacacaagacgccggagcttcacaagggagcgaacgagggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcagaagaaagcataattaaaccaatcgaaaaactatcatgcaatgaaacttttcctgaaaaattagaggacccacaaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcatgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacagaaagattgcaattatttgtttttctactttgaagctatgggagcgatggtaatttcaatcttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcatt

SEQ ID NO: 151330 - DNA, 3767 bp, Homo sapiens
  Payload ID: 9794
  Gene Symbol: MAK
  Gene Name: male germ cell-associated kinase
  Uniprot ID: P20794
  ENST ID: ENST00000536370
  CDS Start-End: 304-2055
tcctaggagatgaaacacacaagacgccggagcttcacaagggagcgaacgaggtaagcagcaggcgcggacagggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcagaatatacctggaacacaaaaactggtcgggggcagttttcaggacgtacttataatcctacagcaaaaaacctaaatattgtgaaccgtgcacagcccattccctcagtgcatgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacagaaagattgcaattatttgtttttctactttgaagctatgggagcgatggtaatttcaatcttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcatt

SEQ ID NO: 151331 - DNA, 2459 bp, Homo sapiens
  Payload ID: 9794
  Gene Symbol: MAK
  Gene Name: male germ cell-associated kinase
  ENST ID: ENST00000538030
  CDS Start-End: 232-1605
agggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcgtcaacaggtgaagatggctgttatttccctctcagcacaccagtttcccacgttatgaatccaactgcagccgttgcaggacagatagaaacatgttacacacaagcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcatgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagt

SEQ ID NO: 151332 - DNA, 3859 bp, Homo sapiens
  Payload ID: 9794
  Gene Symbol: MAK
  Gene Name: male germ cell-associated kinase
  Uniprot ID: P20794
  ENST ID: ENST00000474039
  CDS Start-End: 259-2130
cgccggagcttcacaagggagcgaacgagggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcatgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacagaaagattgcaattatttgtttttctactttgaagctatgggagcgatggtaatttcaatcttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcattaaaaaaaatatggctaa

SEQ ID NO: 151333 - DNA, 6626 bp, Homo sapiens
  Payload ID: 9795
  Gene Symbol: MLEC
  Gene Name: malectin
  Uniprot ID: Q14165
  ENST ID: ENST00000228506
  CDS Start-End: 429-1307
gtgggattccggggccgcctgggcgctgcacccgccacttccgcatcgaaccgccgcttcaaccgaactcactccctctgcgcgcgctccatctggtgcccgactgctgggccggcgcctgggagaagccacgccctttcccgcgcctgacagccaatgagcgggcgcctcccggcggggtggtgggtaattaatgagggccgggcgctgattggctgcagcgtcgtggccgggggcagggcggcggggtaggttgttcctgaggtgggaggcggtacccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacacggaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgacactctg

SEQ ID NO: 151334 - DNA, 549 bp, Homo sapiens
  Payload ID: 9795
  Gene Symbol: MLEC
  Gene Name: malectin
  ENST ID: ENST00000545525
  CDS Start-End: 112-549
tagcattgccctggaaatgcctctggctgttctggggtctttgcttttcttttgtgtcttgcctctgatgtgctttctctttgtcttttgtcctcagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaag

SEQ ID NO: 151335 - DNA, 841 bp, Homo sapiens
  Payload ID: 9795
  Gene Symbol: MLEC
  Gene Name: malectin
  ENST ID: ENST00000412616
  CDS Start-End: 53-706
agccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaagatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggc

SEQ ID NO: 151336 - DNA, 543 bp, Homo sapiens
  Payload ID: 9795
  Gene Symbol: MLEC
  Gene Name: malectin
  ENST ID: ENST00000535656
  CDS Start-End: 1-520
caatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaagatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggagggg

SEQ ID NO: 151337 - DNA, 1089 bp, Homo sapiens
  Payload ID: 9796
  Gene Symbol: MEA1
  Gene Name: male-enhanced antigen 1
  Uniprot ID: Q16626
  ENST ID: ENST00000244711
  CDS Start-End: 156-713
gcggggctggaggactaggcacctctgcacgtcctgccccgccggaagtggaggccgcgggctctgagcgggtgaggcgcgcgggaacaccggcgccgggattcggatgggggcgggtgggggacgctgcagctggggccatttgaggggagcccatggggcctgaaaggcatctgtcaggcgcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagaacatgtagagctggtgaaaaggacaatggctggagtaagcctgcctgcgccaggggttcctgcctgggctcgggagatatcggatgcccagtgggaagatgtggtacagaaagccctccaagcccggcaggcatcccctgcctggaagtgaccacagtgagagctgccttatattcctacattccaggccagaaccagcacaggactgaacacatccctggttgtaatgtccatttccatcttccccgtctccctttccacatcaaggcacatcagacttctcagagacccactttattcagttctgtacatatggggacatcggtccaagcccaacccaccttagcatgtatcactctgtggagaataaagcaccctatgtacacagccaaaagccgcactgcctgcgcccctggaacctgggtccggccttcctcagcccctggcccctccaaggtacctataagggacaagagaaggcctgcccagcatagcacaaacaaggaaataaataggtgttggcagga

SEQ ID NO: 151338 - DNA, 4707 bp, Homo sapiens
  Payload ID: 9797
  Gene Symbol: MSL1
  Gene Name: male-specific lethal 1 homolog (Drosophila)
  Uniprot ID: Q68DK7
  ENST ID: ENST00000398532
  CDS Start-End: 316-2160
gagctccggggatgagctcgggggcggctgggtgcgagctcctgcctctgaggcgaaggcggcggcggcggcagcagaggcggcggcgaggcccccatgggccggcggcgggcctcagccgcggcctccacgtctccgcacgccggcgggatggcgcccgggccccggaggagccgcgctagcggaggcctgctgccgcgctgctgaggcgagcccgccaaactcccctcccccccctcagtcctcgaccccccgcacctcgccccttccccaccccctcctccgcctcggtgcccggcgctgctccggaccactatgaccatgagatccgcggtgttcaaggcggccgcggcccctgccggcggcaatcctgagcagcgactggactacgagcgggctgcggcgctgggcgggcccgaggacgagcctggggcggccgaagcccacttcctcccccggcaccgtaagctcaaggagccggggcccccgctggcctcctcccagggcgggagccccgcgccttccccggccggctgcggcggcaagggccggggcttgttactcccggccggggcggcccccgggcagcaggaagagagctggggcggttcggtgcccttgccctgtccgcccccggccaccaagcaagccggcattgggggggagcctgccgcagccggagccggctgcagcccccggcccaagtatcaggcggtgctgcccattcagacgggctctctcgtggcggcggccaaagagcctacgccctgggctggggacaagggtggggcggcctcccccgctgccaccgcctcggacccggcgggacccccaccactacctctgcccgggccgccacccctcgcgcccaccgccaccgccgggaccctggcggccagcgagggcagatggaagagtatgaggaagagccctctcgggggtggtggcggctcgggagcctccagtcaggccgcctgcctcaaacagatccttctgctgcaattggacctcatcgaacagcagcagcagcagctgcaggccaaggaaaaggagatcgaggagctgaagtcagagagagacacgctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaaggtgtctgatgccatcaagtgttgcaggagaaacttcagtcttggctgttccttcttggagggaccactcagtagagcctctaagggacccaaatccttcagaccttttggagaacctggatgacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaaataaaacaaacaacctcaccatgagctttaggaccagaagaggaatgacaagtgaagcgatgaagcaagccatcttcacagagtagaaaagacatcggagagttggtagataactgtctgaaaagatagttgttcatttgaaactattctgtgatacagtcatgtgggaagggatgtttggctgtgattattttttcagttaatggataacaatttctttactgctcaaaaaccaaaatctttggaaaagaaagtggggatggttagtttcagaacaagttacagctgtaaacaaaagcacttagtatttgggatggcatgccaaaacctgtataaatgtccttgtatcacatcacttctcaagtattccttcattgggcttcatccttttagcagaactcttggtggtgggatagagacttagggagggtagggggagagtgtggaaataggtgcttcctttggctggcaaatgtctacatcttgaaacaaacagatgtacctaatgagcttctccattcactttgtaaaaataatttgtatgtgtaccatcttggtcctctcccctcccgttttgttaaaatatcaggatagcactcccaggccactttggtctcagtgtaagatccctattaactatctgaaaggaaaatagagccaagacctctggtctcaaatatataggaattgcctttctttagtcttcaggactattgtgtgaaaacaagtaggggtctaatctcctagaaggtaggggcttttatccttaaagagaatatgtccccagattattagcacttttagaggagaagccaaggtatgtagggtgtgtggctggcccatcagtggagcacgaagagagaatgggataccattgtgggaagagaagaaaagttcctcaggggcctcccactgctaaagttttttgtgagatgttgatctgtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttcaattgtaaataaactattgtggctgttaatttttgaacttctgcttcaatttattatatttattggcaaacaaacaattctgcttgtatatttgaaacattggaaaaagaaatccattttctcaataaaaaagaataacacattattttccccttt

SEQ ID NO: 151339 - DNA, 525 bp, Homo sapiens
  Payload ID: 9797
  Gene Symbol: MSL1
  Gene Name: male-specific lethal 1 homolog (Drosophila)
  ENST ID: ENST00000582920
  CDS Start-End: 178-525
tatctcatggtgttgatttgtggaagttactcaacatggaggtggcactgctcagactgtactgcagtctaggggtgtgatggtaccgtaattacaacacatcatatccttgtatggggggagtgggaagagaaggaccagtgaaggagaaaaaaatcaaggaaatgtcacccacaaatggtggttaagggctgtgaatcaaaacatatacaaggagatgaaatgagagtatggctgataggggggttctctgctgattgtggaggtttctgctcagttcctgagctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggaaatccccatttgga

SEQ ID NO: 151340 - DNA, 2267 bp, Homo sapiens
  Payload ID: 9797
  Gene Symbol: MSL1
  Gene Name: male-specific lethal 1 homolog (Drosophila)
  ENST ID: ENST00000578648
  CDS Start-End: 30-1826
ctcggtgcccggcgctgctccggaccactatgaccatgagatccgcggtgttcaaggcggccgcggcccctgccggcggcaatcctgagcagcgactggactacgagcgggctgcggcgctgggcgggcccgaggacgagcctggggcggccgaagcccacttcctcccccggcaccgtaagctcaaggagccggggcccccgctggcctcctcccagggcgggagccccgcgccttccccggccggctgcggcggcaagggccggggcttgttactcccggccggggcggcccccgggcagcaggaagagagctggggcggttcggtgcccttgccctgtccgcccccggccaccaagcaagccggcattgggggggagcctgccgcagccggagccggctgcagcccccggcccaagtatcaggcggtgctgcccattcagacgggctctctcgtggcggcggccaaagagcctacgccctgggctggggacaagggtggggcggcctcccccgctgccaccgcctcggacccggcgggacccccaccactacctctgcccgggccgccacccctcgcgcccaccgccaccgccgggaccctggcggccagcgagggcagatggaagagtatgaggaagagccctctcgggggtggtggcggctcgggagcctccagtcaggccgcctgcctcaaacagatccttctgctgcaattggacctcatcgaacagcagcagcagcagctgcaggccaaggaaaaggagatcgaggagctgaagtcagagagagacacgctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaattccttcttggagggaccactcagtagagcctctaagggacccaaatccttcagaccttttggagaacctggatgacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaa

SEQ ID NO: 151341 - DNA, 580 bp, Homo sapiens
  Payload ID: 9797
  Gene Symbol: MSL1
  Gene Name: male-specific lethal 1 homolog (Drosophila)
  ENST ID: ENST00000582884
  CDS Start-End: 1-441
aagggacataaaaggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaaggtcaacttttactcacctgccatgttctgagtttaaggtttgatatccttggccatcaactgttgcagggaaaccaccctaaataatgaagaaaagaagtcgtctcagtgtaaaaaaaaaaagtgggtgtctgatgccatcaagtgttgcaggagaaacttcagtcttggctgttccttctt

SEQ ID NO: 151342 - DNA, 1401 bp, Homo sapiens
  Payload ID: 9797
  Gene Symbol: MSL1
  Gene Name: male-specific lethal 1 homolog (Drosophila)
  Uniprot ID: Q68DK7
  ENST ID: ENST00000579565
  CDS Start-End: 265-1320
tgaccatgagatccgcggtgttcaaggcggccgcggcccctgccggcggcaatcctgagcagcgactggactacgagcgggctgcggcgctgggcgggcccgaggacgagcctggggcggccgaagcccacttcctcccccggcaccatccttctgctgcaattggacctcatcgaacagcagcagcagcagctgcaggccaaggaaaaggagatcgaggagctgaagtcagagagagacacgctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaaggtgtctgatgccatcaagtgttgcaggagaaacttcagtcttggctgttccttcttggagggaccactcagtagagcctctaagggacccaaatccttcagaccttttggagaacctggatgacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgaccttt

SEQ ID NO: 151343 - DNA, 2081 bp, Homo sapiens
  Payload ID: 9797
  Gene Symbol: MSL1
  Gene Name: male-specific lethal 1 homolog (Drosophila)
  ENST ID: ENST00000577454
  CDS Start-End: 41-1426
ccctcctccgcctcggtgcccggcgctgctccggaccactatgaccatgagatccgcggtgttcaaggcggccgcggcccctgccggcggcaatcctgagcagcgactggactacgagcgggctgcggcgctgggcgggcccgaggacgagcctggggcggccgaagcccacttcctcccccggcaccgtaagctcaaggagccggggcccccgctggcctcctcccagggcgggagccccgcgccttccccggccggctgcggcggcaagggccggggcttgttactcccggccggggcggcccccgggcagcaggaagagagctggggcggttcggtgcccttgccctgtccgcccccggccaccaagcaagccggcattgggggggagcctgccgcagccggagccggctgcagcccccggcccaagtatcaggcggtgctgcccattcagacgggctctctcgtggcggcggccaaagagcctacgccctgggctggggacaagggtggggcggcctcccccgctgccaccgcctcggacccggcgggacccccaccactacctctgcccgggccgccacccctcgcgcccaccgccaccgccgggaccctggcggccagcgagggcagatggaagagtatgaggaagagccctctcgggggtggtggcggctcgggagcctccagtcaggccgcctgcctcaaacagatccttctgctgcaattggacctcatcgaacagcagcagcagcagctgcaggccaaggaaaaggagatcgaggagctgaagtcagagagagacacgctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaagtaaggcatagagaacacttgctcttataccctagtggtggcggtcaagctaacaagtgtgaaaatgcctttggcatttttaaaaaagtgcaatcaataaagcagagttctgtcaagaatgagtaagttaacagccagagacagacactgtgcaggcattgcaaatagatggaattacagcaaaatgtgctcaatgtatttgcctgcttacaacactgggagatgtgtttgccagtaagttgctcatcacaagagcaccagacttgggggtgtaatctccggcaacttgcatgccctctgaaagaagggttttctgtgctgtgaaatgcatagaactatactttgccatgcacgactgttcctgcaattgatattgtgtgaaatctgggagggtggtctttgggtgttctcaggggccaatggtaatttttgggttggggagccagcttggggtggggaattttcacctgggcctccgctctttaactatataaacatttatctgtatatctatgtccctgtctggggggcaggaggaatctgccaaagaccaacagtcttactttatcttactatacttcacaaaggttctaaaatgtgaagagtttacttggattgcagtagcccattggttgttcatatatttaaataaaatggtctacaaac

SEQ ID NO: 151344 - DNA, 4692 bp, Homo sapiens
  Payload ID: 9798
  Gene Symbol: MSL2
  Gene Name: male-specific lethal 2 homolog (Drosophila)
  Uniprot ID: Q9HCI7
  ENST ID: ENST00000309993
  CDS Start-End: 734-2467
gcacttcctccccggccttcccctccgggttgaggactcccgcccgcctcgccacctcggggaactgcgggctgcaacccacggggcggagagccagggcgcagtctgggccccgcgtccgatatggagagcgcggcggcggcgtccgccagccgcaacatcaaccttcgtcgccgccgcggcgtcttgcactagatccgggaagccgctgcccgaccgtcgtccttgccgtcgccgccgcctccgcgccctgtactgggatggagtaagaggccctgcagcccgggagaagcgtgccgcgcctcagacggggccggggcctgctcccgcgcctgccagctcgacttgaggaggcgcctccgtgtccggagatggagctcgagtgcaggccgcctgccgagccgcggggctagactgagctccgagtcccgccccgagcgcccaagccgccgcgttctgcgctctgtggtcgctccggacgaactcgaacgctggtttctctctcatatttttggtctggaagtctcagggacggaggggcgccaaggccccatgtgtgggaggattgtttcagctccacaaacttgcacggattttggttacttgtttggccaatggttcggctctgatttcttccgaattgttgcaaattcgccatcgttccctggctgcttactaagttggatccggaatttcttttcaaccgggagccattggtgtcgaagtgtctgcaatgaaccccgtgaatgctactgctctctacatttccgcgagccgcctagtgctcaactacgaccccggagaccccaaggcgtttactgagattaacaggctcttgccttacttccgacagtccctttcgtgctgtgtttgcggacatttgctacaagatcctattgcacccaccaactccacctgccaacattatgtctgcaaaacttgtaaaggcaagaaaatgatgatgaaaccttcctgtagctggtgcaaagactatgagcagtttgaggaaaacaagcagttaagcatcctagtgaactgctacaaaaaactatgcgagtatataacacagactacactggcacgggatataatagaagcagttgactgttcttctgatattttggctttgcttaatgatggatcattgttttgtgaggagacagaaaaaccctcagattcatcctttactttgtgtttgacacattcccctttaccttcaacctcagaacccacaactgatcctcaagctagtttatctccaatgtctgaaagcaccctcagcattgctattggcagttctgttatcaatggtttgcctacttataatgggctttcaatagatagatttggtataaatattccttcacctgaacattcaaatacgattgacgtatgtaatactgttgacataaaaactgaggatctgtctgacagcctgccacccgtttgtgacacagtagccactgacttatgttccacaggcattgatatctgcagtttcagtgaagatataaaacctggagactctctgttactgagtgttgaggaagtactccgcagcttagaaactgtttcaaatacagaggtctgttgccctaatttgcagccgaacttggaagccactgtatccaatggaccttttctgcagctttcttcccagtctcttagccataatgtttttatgtccaccagtcctgcacttcatgggttatcatgtacagcagcaactccgaagatagcaaaattgaatagaaaacgatccagatcagagagtgacagtgagaaagttcagccacttccaatttctaccattatccgaggcccaacactgggggcatctgctcctgtgacagtgaaacgggagagcaaaatttctcttcaacctatagcaactgttcccaatggaggcacaacacctaaaatcagcaaaactgtacttttatctactaaaagcatgaaaaagagtcatgaacatggatccaagaaatctcactctaaaaccaagccaggtattcttaaaaaagacaaagcagtaaaggaaaagattcctagtcatcattttatgccaggaagtcctaccaagactgtgtacaaaaaaccccaggaaaagaaagggtgtaaatgtgggcgtgctactcaaaatccaagtgttcttacatgccgaggccaacgctgcccttgctactctaaccgcaaagcctgcttagattgtatatgtcgtggctgccaaaactcctatatggccaatggggagaagaagctggaggcatttgccgtgccagaaaaggccttggagcagaccaggctcactttgggcattaacgtgactagcattgctgtgcgtaacgctagtaccagcaccagtgtaataaatgtcacagggtccccagtaacgacgtttttagctgccagtacacatgatgataaaagtttggatgaagctatagacatgagattcgactgttaaatcagtgggtcttttaaacctactcctggtagggaaatagctacagttttacggcagctatggttctgttggtttaacttgccggagctcctgcatatagatcacttgtatcaagtgttttcattgctaagttatatgtgttagtgtcggggaaatagtttgcagataatggaggagtaaccctacaactatatgtccttagttcttacagaacctcatagtttgagaacaaagctgatgcaactgatttatacaaaatgaactttggcaagaaaaataacattaacctcattgtttatggccatgctttgtgcataatcaaagtttatgattaaatgtaaggaagtggtatctagtcagtccataaagattgtgctaatttttttgtggaaaagtagccattagttcaggaaactcagtgctgccttcagatgtcattgatgtttctcctgttggaaagctgatgtgtccagctcaacctttgtgctgacatcataccatttctgatcatgaaatattggctactggtgtatgtagcagttcttaaatcagcagtattatgaaaaaaaattccccctcattagaatgtttaagaaatctttttaaaaagtaaaattctgtcagactacaaatgtttagctgttactcatttctagggaagaaattctaaatccctccttcactttgagcagtgttctaattggataaatgaaggagagtagttttattctgaaggtaattaaatttagactatgtagtatgtgacagaatttttttaaaattataaaaagattttatttagtaattgggatttacttaaaataattttggaataatgctcccagacttgcccagatttgtgtattgtacttattgccactggccgccactttgacttattttctctaatagtttatttgccacagtctttattttgaatatgctcctagtttttttttagggtgctgttcattatgaaggcttctttatagaggcctaataagaatgcctttttataaagcctgtgcatttaggtaggttgaagctaggaggattttctttagaatgctcttttgcatgtaaagcacaaagtatgtttcagtttaaatgcacttcttccggttaatttttatggggaagacaagtgagtcacaaacattctgttgaagggaaatctagtcagttgcttgaaagagcacagcccaaataaaacaaggactgactaggtgtaatgaaataacctgtgatttaaaagaagagctgcagctttgacagtgcttatttaaagaaaaatactgctggaaaatttccaatttctactacgttcaccatctctagtaagatctgacatatgctgaagttatgttttgatttggcacacagcatgttcaatgatggttactcgcctagtacaagacatggagaagaaacctttggacacagagcagatgacacctccttctgttttgtagtgtatcctggtgtcattttctgtgaatgtggtcaggtagagttgtttttgttgttgttgttgggcttttttttctttttttttttttggtctcttttggtggggtgggggtgggctaaagccataggaagaaaaatgtgatgtatgtgtccagtatgtactattttgtttttgttttgcaagaagagttgaactatttttgataacaagagtaaatggtggaaaatgcttcttagttgtcttgtctttatttgctttccaagatttggaattttatttaattcctttaagtgttagcagtgtcttatgaaacgtgtatttacctaacgtttgtaacagttttgtgttgaacccagatgccctgctatataaagttgtaaatctgttctttattcactaatgatcactgcaaaaatgattagaaatgagattgtacacatggatgaggatatattttgcaaatcgaccaaactttcctaatattatgatcttaaaattcatagagtactttattgcttcccaagtttgataatcttgtgggtttttttttttttttgatgcatgggaggttggcaatatagacaaagtggaaatcattagtatgtgagggccttgattgttatgtaatattgccaatgatgaattcaggttgtttttagcacaagtttctcttttttatgctggtattctcactgccacatttttggaaacctgtattacaccttaaatctatcaataaatgatagttttctaa

SEQ ID NO: 151345 - DNA, 2272 bp, Homo sapiens
  Payload ID: 9798
  Gene Symbol: MSL2
  Gene Name: male-specific lethal 2 homolog (Drosophila)
  Uniprot ID: Q9HCI7
  ENST ID: ENST00000434835
  CDS Start-End: 241-1752
aaactggtgttacgtgggagtggtgggctaagctgatgaacccacagctggagaacccggcgcggaactttgccccaggttcctccacaaatgctttgacggtttgacggttaacagcgagccggggaaggctgttggtactcgaagtgctttttagctggacatttgctacaagatcctattgcacccaccaactccacctgccaacattatgtctgcaaaacttgtaaaggcaagaaaatgatgatgaaaccttcctgtagctggtgcaaagactatgagcagtttgaggaaaacaagcagttaagcatcctagtgaactgctacaaaaaactatgcgagtatataacacagactacactggcacgggatataatagaagcagttgactgttcttctgatattttggctttgcttaatgatggatcattgttttgtgaggagacagaaaaaccctcagattcatcctttactttgtgtttgacacattcccctttaccttcaacctcagaacccacaactgatcctcaagctagtttatctccaatgtctgaaagcaccctcagcattgctattggcagttctgttatcaatggtttgcctacttataatgggctttcaatagatagatttggtataaatattccttcacctgaacattcaaatacgattgacgtatgtaatactgttgacataaaaactgaggatctgtctgacagcctgccacccgtttgtgacacagtagccactgacttatgttccacaggcattgatatctgcagtttcagtgaagatataaaacctggagactctctgttactgagtgttgaggaagtactccgcagcttagaaactgtttcaaatacagaggtctgttgccctaatttgcagccgaacttggaagccactgtatccaatggaccttttctgcagctttcttcccagtctcttagccataatgtttttatgtccaccagtcctgcacttcatgggttatcatgtacagcagcaactccgaagatagcaaaattgaatagaaaacgatccagatcagagagtgacagtgagaaagttcagccacttccaatttctaccattatccgaggcccaacactgggggcatctgctcctgtgacagtgaaacgggagagcaaaatttctcttcaacctatagcaactgttcccaatggaggcacaacacctaaaatcagcaaaactgtacttttatctactaaaagcatgaaaaagagtcatgaacatggatccaagaaatctcactctaaaaccaagccaggtattcttaaaaaagacaaagcagtaaaggaaaagattcctagtcatcattttatgccaggaagtcctaccaagactgtgtacaaaaaaccccaggaaaagaaagggtgtaaatgtgggcgtgctactcaaaatccaagtgttcttacatgccgaggccaacgctgcccttgctactctaaccgcaaagcctgcttagattgtatatgtcgtggctgccaaaactcctatatggccaatggggagaagaagctggaggcatttgccgtgccagaaaaggccttggagcagaccaggctcactttgggcattaacgtgactagcattgctgtgcgtaacgctagtaccagcaccagtgtaataaatgtcacagggtccccagtaacgacgtttttagctgccagtacacatgatgataaaagtttggatgaagctatagacatgagattcgactgttaaatcagtgggtcttttaaacctactcctggtagggaaatagctacagttttacggcagctatggttctgttggtttaacttgccggagctcctgcatatagatcacttgtatcaagtgttttcattgctaagttatatgtgttagtgtcggggaaatagtttgcagataatggaggagtaaccctacaactatatgtccttagttcttacagaacctcatagtttgagaacaaagctgatgcaactgatttatacaaaatgaactttggcaagaaaaataacattaacctcattgtttatggccatgctttgtgcataatcaaagtttatgattaaatgtaaggaagtggtatctagtcagtccataaagattgtgctaatttttttgtggaaaagtagccattagttcaggaaactcagtgctgccttcagatgtcattgatgtttctcctgttggaaagctgatgtgtccagctcaacctttgtgctgacatcataccatttctgatcatgaaatattg

SEQ ID NO: 151346 - DNA, 559 bp, Homo sapiens
  Payload ID: 9798
  Gene Symbol: MSL2
  Gene Name: male-specific lethal 2 homolog (Drosophila)
  ENST ID: ENST00000491050
  CDS Start-End: 113-559
atgcgcagtgagcccagggtgggttggcagcggacatttgctacaagatcctattgcacccaccaactccacctgccaacattatgtctgcaaaacttgtaaaggcaagaaaatgatgatgaaaccttcctgtagctggtgcaaagactatgagcagtttgaggaaaacaagcagttaagcatcctagtgaactgctacaaaaaactatgcgagtatataacacagactacactggcacgggatataatagaagcagttgactgttcttctgatattttggctttgcttaatgatggatcattgttttgtgaggagacagaaaaaccctcagattcatcctttactttgtgtttgacacattcccctttaccttcaacctcagaacccacaactgatcctcaagctagtttatctccaatgtctgaaagcaccctcagcattgctattggcagttctgttatcaatggtttgcctacttataatgggctttcaatagatagatttggtataaatattccttcacctgaacattcaaatacgattgacgtatgtaatact

SEQ ID NO: 151347 - DNA, 543 bp, Homo sapiens
  Payload ID: 9798
  Gene Symbol: MSL2
  Gene Name: male-specific lethal 2 homolog (Drosophila)
  ENST ID: ENST00000473093
  CDS Start-End: 259-543
gtgcgagcgctagcgacgacggcggcgggggagtctcggggatgacagtggctttgcccgttggggtaacggtcgtcgtcgccgccagcagaggcctgaggcgccacacagcccgcgggatccattaaggccgcagcagcccgggccctaccgagctggagtggcgcgtggagtcggggacatttgctacaagatcctattgcacccaccaactccacctgccaacattatgtctgcaaaacttgtaaaggcaagaaaatgatgatgaaaccttcctgtagctggtgcaaagactatgagcagtttgaggaaaacaagcagttaagcatcctagtgaactgctacaaaaaactatgcgagtatataacacagactacactggcacgggatataatagaagcagttgactgttcttctgatattttggctttgcttaatgatggatcattgttttgtgaggagacagaaaaaccctcagattcatcctttactttgtgtttgacacattcccctttaccttcaacctcagaacccacaactgat

SEQ ID NO: 151348 - DNA, 576 bp, Homo sapiens
  Payload ID: 9798
  Gene Symbol: MSL2
  Gene Name: male-specific lethal 2 homolog (Drosophila)
  ENST ID: ENST00000481989
  CDS Start-End: 114-576
agctcggtgaagtcctgatcggcacccatgaaggacatttgctacaagatcctattgcacccaccaactccacctgccaacattatgtctgcaaaacttgtaaaggcaagaaaatgatgatgaaaccttcctgtagctggtgcaaagactatgagcagtttgaggaaaacaagcagttaagcatcctagtgaactgctacaaaaaactatgcgagtatataacacagactacactggcacgggatataatagaagcagttgactgttcttctgatattttggctttgcttaatgatggatcattgttttgtgaggagacagaaaaaccctcagattcatcctttactttgtgtttgacacattcccctttaccttcaacctcagaacccacaactgatcctcaagctagtttatctccaatgtctgaaagcaccctcagcattgctattggcagttctgttatcaatggtttgcctacttataatgggctttcaatagatagatttggtataaatattccttcacctgaacattcaaatacgattgacgtatgtaatactgttgacataaaaactg

SEQ ID NO: 151349 - DNA, 2345 bp, Homo sapiens
  Payload ID: 9799
  Gene Symbol: MSL3
  Gene Name: male-specific lethal 3 homolog (Drosophila)
  Uniprot ID: Q8N5Y2
  ENST ID: ENST00000312196
  CDS Start-End: 106-1671
cggccccccccggccacggcgcaccgcctccccgcccccgcccgccctcccccaccgcgcgcgctccgcccgccccggagcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaagaa

SEQ ID NO: 151350 - DNA, 3446 bp, Homo sapiens
  Payload ID: 9799
  Gene Symbol: MSL3
  Gene Name: male-specific lethal 3 homolog (Drosophila)
  Uniprot ID: Q8N5Y2
  ENST ID: ENST00000337339
  CDS Start-End: 28-1278
agcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatgctaatgggttgtttagctttttgttttctttgtactctgtctctgtagtctctccattctaaagtttaatttggaaaggtctgtcctgaattatcaaagtaagaatactcagatttccataagctcttctcacctcctcttagcccaactcaaactccatcagatcttctcaccttgattttgagctggaatgtttcaatgagcaaaataaattagacaaaagtttactttctttttttccaaaatacacacaggttgatttgctgtaatataaaacttagaagtaaaccactgctaattaatcattttaaactttcaaaaactgctaaaacaggtgccatgaatcaggtacaattactgtagaaactaacattagctattatacactaaccaggcatttttcccaaattaattacaatctggttgtttagcctatgctaattaagccctcttagtagtagtattcactttacattgaagacctcattcacaaatacagggtgctctgtgcttatatccttccacccttgactgccaaaaatgtgtgaaatggaaagttgatggcagcagggccgacgatgtcacctggtgcctcgcgggctcagtgagttaggaagtcagcagcaggggaggcagcttgcatgcctgtcccccggcacactgtgtggaggtggaaacagagctacgccagcaggcgccaagcacccaactccagagatggaagcctggtggccttcctttcacagagctcagctgctcgcaggctgtgaaatctaagacacccctcataaatatcaaaaacacctccaaagctaacgtcagggtaaaactacttggagtcgaatccccatgccccagtaggtgtatcttgtgtatgacctgtgccctgttcttccctcagcctcgcctgctgtgctgactccttcaggggtccttctaagcatcatcctgttggaactcccaaaagtcatcccagtgccattctgtgttcaggtgcccatttccttgtgtacatcctgtccctgccacatccataagctcctgagagaaaggtctgacttgttgattgtgtcaccccatcacagctcagtgttggtggcatagttccaggtgcgtgaaagtatttgctgattctttgaagattgggaaggctcagaagggcagagttgaagaaggcatacctttaagagaagccctttgaataatcaagtgctaaaacaaaatcaggtgcttttttaaaacagcttgattgagatataatccacataccttaaaattcacacatttaaagtttttagtgtctccagacacagtggttcatgcctgtgagactggggcaggaggatcacttgaggccaggagttcaagatcagcctgggcaatatagtgaaaccccatctcttaaagaaaaagttagccaggtgtgatgatgtgcacctatagtcccagctacttgggaggctgcagctgtggctgtggctgaagctggcggatcgcttgaggcccagagtctaagactgcagtgagctctcattgggccactgcagtcgagcctgggcgacacaaagagaccaccctgtctgatagataactaacaaaatagttttagttgggcaaaattaaagagttgggcaaccatcactgaaatcagtttcagacattttcaccactccaaaaaagaaaccccacatcgactagcagttactcatttgcttctccctatgtcccctgacaaccactaatctatttgtctctatagatttgccagtttggggcatttcatataaatggaatcatctgtatgtaagtggttaataaggattggttgattgaagattgaaaagggtcagctgggaaaatttttaaaaagactgtttttaaaaaggtgctacaaaataaagtgctatctttttctgtt

SEQ ID NO: 151351 - DNA, 2256 bp, Homo sapiens
  Payload ID: 9799
  Gene Symbol: MSL3
  Gene Name: male-specific lethal 3 homolog (Drosophila)
  Uniprot ID: Q8N5Y2
  ENST ID: ENST00000361672
  CDS Start-End: 470-1588
cggccccccccggccacggcgcaccgcctccccgcccccgcccgccctcccccaccgcgcgcgctccgcccgccccggagcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttg

SEQ ID NO: 151352 - DNA, 589 bp, Homo sapiens
  Payload ID: 9799
  Gene Symbol: MSL3
  Gene Name: male-specific lethal 3 homolog (Drosophila)
  ENST ID: ENST00000380691
  CDS Start-End: 1-351
gtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggt

SEQ ID NO: 151353 - DNA, 1071 bp, Homo sapiens
  Payload ID: 9799
  Gene Symbol: MSL3
  Gene Name: male-specific lethal 3 homolog (Drosophila)
  ENST ID: ENST00000380692
  CDS Start-End: 482-1071
ccacttgggggaaaaaaatgaaaggaaaaatatttcaacccggctgtcggtctaaaagaggagagaatgctttctttaaaaaaggattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctga

SEQ ID NO: 151354 - DNA, 2377 bp, Homo sapiens
  Payload ID: 9799
  Gene Symbol: MSL3
  Gene Name: male-specific lethal 3 homolog (Drosophila)
  Uniprot ID: Q8N5Y2
  ENST ID: ENST00000380693
  CDS Start-End: 638-1705
cagaagcctcacactgtctcacgctcagagaccaatcacggggtggttggacggatgtttcctattttgaaggcgtccacttgggggaaaaaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaag

SEQ ID NO: 151355 - DNA, 2324 bp, Homo sapiens
  Payload ID: 9799
  Gene Symbol: MSL3
  Gene Name: male-specific lethal 3 homolog (Drosophila)
  Uniprot ID: Q8N5Y2
  ENST ID: ENST00000398527
  CDS Start-End: 127-1656
gcacgcgcggttgggagcctcgcccatgctttgtcgcgttaccggggctaccgtttgcgcccccgactgcaacggtggccgctgagggaggaggcttctcgaatacggtttctgtcttcgcgttaaatgtctccttctgtgcggcctggtgccgggtgggctcctgtgggacgccctggccgtccgatccagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttg

SEQ ID NO: 151356 - DNA, 795 bp, Homo sapiens
  Payload ID: 9799
  Gene Symbol: MSL3
  Gene Name: male-specific lethal 3 homolog (Drosophila)
  ENST ID: ENST00000421368
  CDS Start-End: 123-795
gcgcggttgggagcctcgcccatgctttgtcgcgttaccggggctaccgtttgcgcccccgactgcaacggtggccgctgagggaggaggcttctcgaatacggtttctgtcttcgcgttaaatgtctccttctgtgcggcctggtgccgggtgggctcctgtgggacgccctggccgtccgatccagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccac

SEQ ID NO: 151357 - DNA, 1646 bp, Homo sapiens
  Payload ID: 9799
  Gene Symbol: MSL3
  Gene Name: male-specific lethal 3 homolog (Drosophila)
  ENST ID: ENST00000468149
  CDS Start-End: 12-395
acgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagt

SEQ ID NO: 151358 - DNA, 560 bp, Homo sapiens
  Payload ID: 9799
  Gene Symbol: MSL3
  Gene Name: male-specific lethal 3 homolog (Drosophila)
  ENST ID: ENST00000476743
  CDS Start-End: 504-560
gcacgcgcggttgggagcctcgcccatgctttgtcgcgttaccggggctaccgtttgcgcccccgactgcaacggtggccgctgagggaggaggcttctcgaatacgattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggag

SEQ ID NO: 151359 - DNA, 3371 bp, Homo sapiens
  Payload ID: 9800
  Gene Symbol: ME1
  Gene Name: malic enzyme 1, NADP(+)-dependent, cytosolic
  Uniprot ID: P48163
  ENST ID: ENST00000369705
  CDS Start-End: 118-1836
agtgcggccgccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggacttggcctttaccctggaagagagacagcaattgaacattcatggattgttgccaccttccttcaacagtcaggagatccaggttcttagagtagtaaaaaatttcgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaagctagaaatgaatctaggcgtaggtgaacttttgctaagcagaaataacactactttgttgcctagagaaagataacttctcaagtatttttattccagtcctagatcatatatgttcttttgtgcaacggaattctaacagttctaagagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcccgaggttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatgactaataccattctatgagaaagagtagttatatgcccagactgtattaatttactttagaaactaatgtttgaagtaatggaaaaaattttaaattataaagctaaggtgcaataacatttgctacttatttatagaattatttgaagaattttgtttttgaagtaatgctttaaggagtataagatattcaagataaattatactataaaatgattttattgaaagttgaaggttacacaaattgttttaggtatgagcagaagaggttaaggtatttctaaaggtaacatatagtcaagagtttcctcaaaatagttatttggagaagaatcagaatgtctgtgtatttcttgtctgtttctatgttgtcttatagctctgactaaatgtgtttacctatgcaaaagatttattaaagcatagaaaaggtgaatgaataaaaatataaaataattgtcctttttcttaaaa

SEQ ID NO: 151360 - DNA, 9100 bp, Homo sapiens
  Payload ID: 9801
  Gene Symbol: ME2
  Gene Name: malic enzyme 2, NAD(+)-dependent, mitochondrial
  Uniprot ID: P23368
  ENST ID: ENST00000321341
  CDS Start-End: 273-2027
cccgtccgtctccaccgtgggccacgccttccgggccccgcggctggccggctcctcgcgccctcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggtgtggctttagctgttattctctgtaacacccggcatattagtgacagtgttttcctagaagctgcaaaggccctgacaagccaattgacagatgaagagctagcccaagggagactttacccaccgcttgctaatattcaggaagtttctattaacattgctattaaagttacagaatacctatatgctaataaaatggctttccgatacccagaacctgaagacaaggccaaatatgttaaagaaagaacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacagtcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattttcaccaaattttaaggaaaaattgtcattatctaaaaatgttcttatatatctgcttcatcttaccttcatactctgaaattccctatagcagacagagctagggaaatattaaaaatttaccctatttattttctggaactaaatcaagccttaactataacattatgagagtaatgggaactactgctggctttaagtaaataaaagtcattgttttcaacagtgtataaaaatcatagtgtaacctttttatttaataaatatcttacatttaattgcttcagttatgctatcttattgcccaactagaaatttagatttgcttatgaaaaacacatatttttgttacttctagatgattctaggagggagtataagatacctaatcatatgggaacatcacgtgactttttaaatctaaattagtcatgcttcacatcaaaatgagtcatatttaactggagaaactatgcccttattccagaactgatgctctttattgcttgagataattttggaatgttactatgatactgtttctttgaatatcattagtagtgacaactctttctccattgaaggcagacttaatttttttaaaccaccaacattaatttagagctaaatggggatgaataaggttggtgttcatctgggaaatgccttttttaatcccagtaaaatgggtaataatggctatccagaacagttttcttgtgtggcttgcatattgaagaattctaaaggaaaatatatctgcctaccatgcttgctcttagggaagaaaacttaaatgctcattctaggatagtaacaacaacagataattcatcgataatatgagcatgcacagtatttgatattgctctgtaggaaaaaagagacttcatttttttcatcttctgcctatgaatacaaattgattctttttttttttttttttttttgagacagagtctcactctgttaccaggctggagtgcagtggtgtgatctcagctcactgcaacctctgcctcccaggttcaagcagttctcctgcctcagcctcccaagtagctgggactacaggtacacgccaccacgcccagctaatttttgtatttttagtagagacgggatttcaccatgttggccaggagggtctcgatttcctgacctcgcgatccgcccacctcagccttccaaagtgctgggattacaggcgtgagccaccgcacccagccaattttttttttttttttttttgagacagagtctcgcttttgtcgcccagtctggagtgtagtggcatgatctctgcaacctctgcctcctcggttcaggcgattcttctgccttagcctcccaagtagctgggattacaggcaccggccaccacacccagctaatttttgtatttttagtagagatggggtttcaccatgttggccaggctggtctcaaaatcctgacttcaggtgatccacccactttggcctcccaaagtgctgggattacaggcgtgagccaccacacctggtccaattcatcataattctgaatataatttaataattttaaaatggtcgcaatggcattgccatttggagtatgggaaaatgcagttggttaattcattgaacagattagtaaagtcagaagtctttttcataacatacggtcacaattcctttcttttaattaaagacaaaaggtttatgggttttggtttgtttgttttagatatggggttttgctatgtcacccttgctggagggcggtggctgttcacaggcgtgggtcatagagcactgcagcctggaactcctgggttcaagctctcctcctgcctcagcctcctgagcagcttggactaaaggtgtgcaccaccgcacctggctgagaggcttctgtttttcatgttccctttatcaaaacaaaatcacgcctaaacatactctctgtgtgaaatcttgattttagttcaacctaagaaatataataaatataaacctgtttcttgcttagtgtttattgaaggcaggaacgtatgctgaattaaagtaattttactacgaagtttgcttattaagtatgcctggtacagtcttcatggaagttattaagtattttaaggaaaaaaataggctaaatggcatatagcctgcttaaataaaataattctatttttttaaaaagctcccaattgtcattgttatttaccagtcaatctttcaacaagtatcaattattggatgtaaattaaagtaaaattgcttaatatttaagctaagaatacaggaaggactatgagcattgaggaaatcgggggaggccagaatggcatcaagctggaaaagaaattaaaacattaccttcgatgagactttacctagcaagaaggtaattattttgaataacagcaatagagaatcttttattttgaattgagaagaaattctgatgattagagtgtcagtaagtagtaggaaaaggtaagaatacatgtgtttctaatctcccaccaccacctgttgtatggaacaaattggattactagcaagggtaaggtttattgacaatgagaagttttagtccaagattttagttaaaatattttaaaattttttgattcataaccaagaagttgcctcagatcactgtgaagctttaaaatgcaggtgcctttgctcctcctccctccaggcccccgggggcagagccctggctggtgtctcttcaggaggacccctgacacaccgattctgccctcacaatcactgccttaaagcaggcagcagaatcttttggagaactaacaagattctgatgctgatgcatagggcctggggtggggcctcagattctgcttttttttttttttttttttttttttttaaacagggtctctttctttttcctttctcactcaggctgcagtgagtggcgtgatcttggctcactgcaacctccacttcctgggctcaaacgatcctcccgcctcagcctcctgagtagctgggactataggcgcaagtctatgcaaccacccagctaatttttgtatttttagaagagtgggggttttgccacgttgcctgggctggtctcgaactcctgacctcaagtgatccaaccacctcagcctcccaaagtgctggaattacaggcatgagccactgcacccagccaagaatgtccacttctgacaagctcccaggtgatgcctatgctgctggtacagtgaacaacatgctgagaggcattgctccaggatactgcatgtagtgagcagttctttagcgtttatgtgtcatatacttcaagttacatgaaaaagatcaactgaaattatgttcttacacagaatagttttcatctagttttattatgtttttacaggctgtttacaagaacaaaaatagagaatttttgaacatatttttctgaaaacataaaaactagagtactctttaattctaaattatagatttgtagcatacttagtaaacttagtaaccaattttcatttgtaaaagattagctatcaaatggacatttatttctcttagttttcttatgacatgacttgccttatatcctttgtcctttttctgtaacttgtcagcctctggagaaataggattttacatttttgcaaatgagttgccaatgaattaagatcaaaacgtcattattaaggagtatgaagcattatttactggctctcagataacagaaaacccaaaagggatggtggcggagtgaagaaagccttgccttgggaaaaatacttcaaatgctcccatagttttttttcctcaagcccagtcagtatccttcaaggataactttttcataccttttttttggtttgtttgtttctgctagctttatgacagaggttataatattcttttctcctctcttctttgacgtgttacgttgtctttttttttttttttttaacttcttcatactcttaaaaagctccagaatggccaggcgcagtggctcacgcctataatcccagcactttgggaggccaaggcaggcggatcacgaggtcaggagatcaagaccatcctggctgacacggtgaaaccctgtctctactaaaaatacaaaaacttagccaggcgtggtggcgggcgcctgtagtcccaggtactcgggagtctgaggagtgaacccgggaggtggaggttgcagtgagctgagatcgcaccgctgcactccagcctgggcgacagagtgagcctccatctcaaaaaaaaaaaaaaaaaaaaaaaaaaaaaaaaaaaaatctccagggttctgttgaattcaccaaaatggggtcagctctggtgagcctatgtaatactcgagaacattaatataaacccatagctctttactgggcttccatttaaagggaagtcctaagaatgaaatggcaccagcatcctgtttccatccaagacaagaccacacgtgttcaggtgccatgtattcatatagctctcaactgattggtgatttgcactttgtgcatctaattattaaaatgaaactctctacaggtgagctgaagtaacatacttcatatttaaaaagttcacagcaatttgaccatagaaaactttctcatctgaaatcagggtaagtttttttaatgtaagcagagaaaaaaataaagcagtgttttatttcaaatttcagtaagttcaggtgggcctaattaagacatgactattattacaaatcctattcttgccagaagttacttagatagattagtgattagattttaaaaacattattttcctttcttgaataaggaaaattgtgcatctcaaagagaaaagtaaatatggaaatatgttcatagttcagttgcataaaatagacacattaagtcaagtgatttgaatgcttagtgtcttttggtaaacagcattttgtcaacaaacttttcatatggctatagaatcttgttttttccaaataaaaactttgcaattgggagttattcctccattcagcacactttttaatgttaagactaggggaaacttgtgggtatatattcagtggttttcaggattttcttttatgttctagaaaagtaatttttcctttcctagttttaagtatatattcaagcaaatcgttgattcctatacagccattggattatcaccaacacatttggtatatacagtgggccgataatgacaaactaaagtttgtggttaatacctactctataccagacactgttctaaggatccgacatatttaatcctctgtttaccctctgtttctgtgcctgatttacagacagagacagaggcacagagaggttaaatgacttgtcaaaggtcttatgatgtgtggcagagcctgggtttttagctcaaacccctctcagtgaagaaagccttctgtgtaggcaatttcatctaataccttcatgaattgttacttcagatgagaattctcacttattcttttttttttttttttttcttttctttgagacagccttgctctgtctcccaggctggagtgcagtggcgcaatctcagctcactgcaagctccgcctcccgggttatgccattctcctgcctcagccttccgagtagctcggactacaggcgcccgccacctcgcccagctaattttttgtatttttagtagagacggggtttcaccgtgttagccaggatggtctcgatctcctgacctcatgatccacccgcctcggcctcccaaagtgctgggattacaggcgtgagccaccgcgcccggcctcacttagtcttttaccagttcatctgatttttactttgttcccatttataattcaaatataatataaacgtcttattcatttagtcttcagcattttaagtattcgacacgaacattaaagatttggtgttgaatttaataaattacaccaaaaagtctcagtagccaattcactaacatcttttgatttggtaatcttcacagaatcaacaactgttaacacttctgtgcaaataaatttcagttgtgcttatatattataatattcactttaggaatccacctgtcaatttgcaattcaattataaggtatattttaagtgatatctatgtattgtatacacatattccattgaaaggtgagaataattagaaagtagtaatataaaaatgtgtatgaaataagaactttcttaaaagacctagtttagctaaatatatgacaatataaaatgtctgcccaatgttttattatactttgtctaatgacctttaaatttaactgaaattaaaaccgtacttttgcagttgatatttttgtgttccctttgttaacataccaagcactaattattgacttcaaggaagccacgtattgcaagtcattgcttagcctttcacatctgagtgttgataagatgacggaatgggtagtcttgtagtaattgcttatgggaatgctagtttaagaggaatgccttgtatagaacatattataccagattgacttgttaaaaatggttccaagaatcagtctaaaaacttcagaattatgtgaattattttttctctgttgtgatatgttgtaatgagatgtgtgttcttatattttcttagtaaaattttcttaagcataaaa

SEQ ID NO: 151361 - DNA, 2492 bp, Homo sapiens
  Payload ID: 9801
  Gene Symbol: ME2
  Gene Name: malic enzyme 2, NAD(+)-dependent, mitochondrial
  Uniprot ID: P23368
  ENST ID: ENST00000382927
  CDS Start-End: 202-1641
ctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggttacagaatacctatatgctaataaaatggctttccgatacccagaacctgaagacaaggccaaatatgttaaagaaagaacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacagtcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattttcaccaaattttaaggaaaaattgtcattatctaaaaatgttcttatatatctgcttcatcttaccttcatactctgaaattccctatagcagacagagctagggaaatattaaaaatttaccctatttattttctggaactaaatcaagccttaactataacattatgagagtaatgggaactactgctggctttaagtaaataaaagtcattgttttcaacagtgtataaaaatcatagtgtaacctttttatttaataaatatcttacatttaa

SEQ ID NO: 151362 - DNA, 1068 bp, Homo sapiens
  Payload ID: 9802
  Gene Symbol: ME3
  Gene Name: malic enzyme 3, NADP(+)-dependent, mitochondrial
  ENST ID: ENST00000323418
  CDS Start-End: 289-1068
gctcctcaccccgcctgctccgcagcgggaccgcgtagacctcagctccccgagcagcgcaggtgggccagggaaggagaggaccgaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaagatgacttctccagaggcccaaagaggtcacaacttttcttcaagtga

SEQ ID NO: 151363 - DNA, 2240 bp, Homo sapiens
  Payload ID: 9802
  Gene Symbol: ME3
  Gene Name: malic enzyme 3, NADP(+)-dependent, mitochondrial
  Uniprot ID: Q16798
  ENST ID: ENST00000393324
  CDS Start-End: 255-2069
caccggatctgcttccagggcttggtttcgctttgcctggctcttggctaggcctggcgccccgcgcggagccgagcaggtggcagccgaggagtggcgggggctggaacatttaaccctttgggagcacctgccctctcccagagggcgcgtccccggatcaggcccggtgccccgcagcgcgcgtgggtcctggctggctggaaggaggccctgaccttgctttctctcccgtgccaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaagtgaatccttgtcgctgtgttttttcttttaaactttctggtgtgagaggagatgccaaggcatacagtgaataaaagccttgtctctgaa

SEQ ID NO: 151364 - DNA, 2069 bp, Homo sapiens
  Payload ID: 9802
  Gene Symbol: ME3
  Gene Name: malic enzyme 3, NADP(+)-dependent, mitochondrial
  ENST ID: ENST00000524826
  CDS Start-End: 328-2069
aaacgcaaatccccctctgtgcatttagtcttgccaagatggagagtctcaggcgggcattctgagctgcttcttgtcactggggaaaaccacgtgcacgcagtgctgaggcgccccacgcgcgtcctcaggggaagccaggcactgagaacaaaggttgtgggaccgctctttgaggaactcaccagctccgcgagctcgcggccgccagcgcggtccacccattggcgggagaggactcacagaccgcagctcctcaccccgcctgctccgcagcgggaccgcgtagacctcagctccccgagcagcgcaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacac

SEQ ID NO: 151365 - DNA, 1776 bp, Homo sapiens
  Payload ID: 9802
  Gene Symbol: ME3
  Gene Name: malic enzyme 3, NADP(+)-dependent, mitochondrial
  Uniprot ID: Q16798
  ENST ID: ENST00000526504
  CDS Start-End: 328-1356
aaacgcaaatccccctctgtgcatttagtcttgccaagatggagagtctcaggcgggcattctgagctgcttcttgtcactggggaaaaccacgtgcacgcagtgctgaggcgccccacgcgcgtcctcaggggaagccaggcactgagaacaaaggttgtgggaccgctctttgaggaactcaccagctccgcgagctcgcggccgccagcgcggtccacccattggcgggagaggactcacagaccgcagctcctcaccccgcctgctccgcagcgggaccgcgtagacctcagctccccgagcagcgcaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggaacaacctgccacactttcagctgcccatggcatttatgggcacaagtcatgttccagcacatccctggacccatgggcttctcagagtggttacctcgaaacagctaagtagcttcctttccagttttaaacccctagtgcatagcccaagagcaccccaaaaatgcaggttaatgatggagataactttatttgccaaattttgtaatttggagcttaagaaccactgtttttcctcttgagttctggcctgtaccaagtgcagaaatagcttcccaaaggaaaaaaatgggcaacagtaccaaatgctgctgagaggtcaagaaagaagaaggctgagaactgattactgaatttggccacctggaggtacttggggaccctgacaagaggcacagcctccgttgctgtggcagggatcttggctgctctgcgaatcaccaagaacaagctttccaatcacgtgtttgttttccaaggtgcaggcgaggcagctatgggcattgcccacctccttgtcatggccct

SEQ ID NO: 151366 - DNA, 487 bp, Homo sapiens
  Payload ID: 9802
  Gene Symbol: ME3
  Gene Name: malic enzyme 3, NADP(+)-dependent, mitochondrial
  ENST ID: ENST00000526944
  CDS Start-End: 305-487
tttagtcttgccaagatggagagtctcaggcgggcattctgagctgcttcttgtcactggggaaaaccacgtgcacgcagtgctgaggcgccccacgcgcgtcctcaggggaagccaggcactgagaacaaaggttgtgggaccgctctttgaggaactcaccagctccgcgagctcgcggccgccagcgcggtccacccattggcgggagaggactcacagaccgcagctcctcaccccgcctgctccgcagcgggaccgcgtagacctcagctccccgagcagcgcaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaag

SEQ ID NO: 151367 - DNA, 814 bp, Homo sapiens
  Payload ID: 9802
  Gene Symbol: ME3
  Gene Name: malic enzyme 3, NADP(+)-dependent, mitochondrial
  ENST ID: ENST00000530335
  CDS Start-End: 360-814
gtgcatttagtcttgccaagatggagagtctcaggcgggcattctgagctgcttcttgtcactggggaaaaccacgtgcacgcagtgctgaggcgccccacgcgcgtcctcaggggaagccaggcactgagaacaaaggttgtgggaccgctctttgaggaactcaccagctccgcgagctcgcggccgccagcgcggtccacccattggcgggagaggactcacagaccgcagctcctcaccccgcctgctccgcagcgggaccgcgtagacctcagctccccgagcagcgcaggtgggccagggaaggagaggaccgaggcaagccaccacgcgggattaggggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgacttt

SEQ ID NO: 151368 - DNA, 384 bp, Homo sapiens
  Payload ID: 9802
  Gene Symbol: ME3
  Gene Name: malic enzyme 3, NADP(+)-dependent, mitochondrial
  ENST ID: ENST00000532471
  CDS Start-End: 146-384
cagcgcggtccacccattggcgggagaggactcacagaccgcagctcctcaccccgcctgctccgcagcgggaccgcgtagacctcagctccccgagcagcgcaggtgggccagggaaggagaggaccgaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggtaatgggccagagggcaggacggcccgcgttgcgatcccgtggctgccggaaaat

SEQ ID NO: 151369 - DNA, 298 bp, Homo sapiens
  Payload ID: 9802
  Gene Symbol: ME3
  Gene Name: malic enzyme 3, NADP(+)-dependent, mitochondrial
  ENST ID: ENST00000526834
  CDS Start-End: 114-298
cctgctccgcagcgggaccgcgtagacctcagctccccgagcagcgcaggtgggccagggaaggagaggaccgaggcaagccaccacgcgggattaggggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggt

SEQ ID NO: 151370 - DNA, 2311 bp, Homo sapiens
  Payload ID: 9802
  Gene Symbol: ME3
  Gene Name: malic enzyme 3, NADP(+)-dependent, mitochondrial
  Uniprot ID: Q16798
  ENST ID: ENST00000543262
  CDS Start-End: 328-2142
aaacgcaaatccccctctgtgcatttagtcttgccaagatggagagtctcaggcgggcattctgagctgcttcttgtcactggggaaaaccacgtgcacgcagtgctgaggcgccccacgcgcgtcctcaggggaagccaggcactgagaacaaaggttgtgggaccgctctttgaggaactcaccagctccgcgagctcgcggccgccagcgcggtccacccattggcgggagaggactcacagaccgcagctcctcaccccgcctgctccgcagcgggaccgcgtagacctcagctccccgagcagcgcaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaagtgaatccttgtcgctgtgttttttcttttaaactttctggtgtgagaggagatgccaaggcatacagtgaataaaagccttgtctctg

SEQ ID NO: 151371 - DNA, 6414 bp, Homo sapiens
  Payload ID: 9803
  Gene Symbol: MFHAS1
  Gene Name: malignant fibrous histiocytoma amplified sequence 1
  Uniprot ID: Q9Y4C4
  ENST ID: ENST00000276282
  CDS Start-End: 588-3746
ccggcgggcggcgctgccgcttcccaatcgcgccctcccagcgccggggacgcggcgcccgcgctcccgcccgagcccggggaaacggagacaaggaggcgccgccgccccctccccgcggctgcgccccagccctgcgcccgcagcatgcccgccgccgggccgagcgccgccctcccccaggagctcgaggaggcgacgccgctgccggccgcgggaccgcggctgcgagggtagcggggccggagccgggccccccgaggcgccgcgcggcgggcggagagggaggaggagcaggcatcctccgcggcgcgcgggcggcggccctgctgcccggcgcgcccatggcccggccgcagggagaatgcaagctgctctccacgcgctcggcgtcccccggagccgctcgcgtcgccgccgccccctagccgccagcgctcggccgctggctgcgctaggacccgcggccgccggccgccgagcgcgggagggcaggcaggggcaggagccggagggcccggggcgcggcgcggcatgtagctgcgggctcccgcgtccgcgtgaggctgtcggcccggggccccgccatggctgggatggacagtggcaacctgaagaccgcgaggctgtggcgggacgccgccctgcgtgccaggaagctgcggagcaacctgcgccagctcacgcttaccgccgccggggcctgccccggggccggggccgacgcgctcgagtcccccgcctccccccagctcgtgctgccggccaacctcggggacattgaggcactgaacctggggaacaacggcctggaggaggtacccgaggggctggggtcggcgctgggcagcctgcgcgtcctggtcctgcgcaggaaccgcttcgcccggctgcccccggcggtggccgagctcggccaccacctcaccgagctggacgtgagccacaaccggctgaccgccctgggcgcggaggtggtgagtgctctgagggagctgcggaagctcaacctcagccacaaccagctgcccgccctgcccgcccagctgggcgctctcgctcacctggaggagctggatgtcagctttaaccggctggcgcacctgcctgactccctctcctgcctctcccgcctgcgcaccctggacgtggatcacaaccagctcactgccttcccccggcagctgctgcagctggtggccctggaggagctggacgtgtccagcaaccggctgcggggcctgcctgaggatatcagtgccctgcgtgccctcaagatcctctggctgagtggggccgagcttggcacgctgcccgccggcttctgcgagctggccagtttggagagcctcatgctagacaacaacgggctgcaggctctgcccgcccagttcagctgcctgcagcggctcaaaatgctcaacctctcctccaacctcttcgaggagttccctgccgcgctgctgcccctggctggtctggaggagctctaccttagtcgcaaccagctcacctcggtgccatcccttatctcgggcctgggccggcttctcaccttgtggctggataataaccgcatccgctacctgccggactccatcgtggagctgaccggcctggaggagctcgtgctgcaggggaaccagatcgcggtgctgcccgaccactttggccagctctcccgggtgggtttgtggaagatcaaagacaacccactgatccagcccccctacgaggtctgcatgaaggggatcccctacatcgcagcctaccagaaggaactggctcattcccagccggcggtgcagccccggctcaagctgctcctgatggggcataaggctgcaggaaagactttgctgcgccactgcctcaccgaggagagagtggagggatgcccaggaggaggggacaaggagaagtgctacccaccgtcacctccccctgtgagcaagggcatcgaggtgaccagctggacggccgatgcctcccggggcctgcggttcatcgtgtatgacttagctggggatgaaagttatgaggtgatccagcccttcttcctgtccccaggggccctatacgtgctggtggtcaacttggccacctatgagcctcgccactttcctaccaccgtgggctccttcttgcatcgggtcggggcgagagtgccccacgcggtggtgtgcatcgtgggcacccacgcagacctgtgcggagagcgtgagctggaggagaaatgtctggacattcaccgccagatcgccctgcaggagaagcacgacgcggagggactgagccgcttggccaaggtggtggacgaggcactggcccgggacttcgagctgcgctctgccagcccccacgcagcctactatggcgtttcggacaagaaccttcgacggcgcaaggcccattttcaatacctgctcaaccaccggctgcagatcctctcccccgtgttgcctgttagctgcagggacccgcgccacttacgacgccttcgggacaagttgctgtcagttgctgagcaccgagagatcttccccaacttacacagagtactgcctcgatcctggcaggtgctggaggaactgcatttccagccacctcaggcccagcgactgtggctaagctggtgggactcggcgcgcttgggcctgcaggcgggtctgaccgaggaccgactgcagagtgccctctcctacctgcatgagagcggcaagctactctactttgaggacagtccggctctcaaggagcacgtcttccacaacctcacccgcctcatcgacatcctcaatgtcttcttccagagggatccctctttgctgctgcataagctgctcctagggaccagtggagagggcaaggcggagggggaaagctccccgcccatggcgcggtccacccccagccaggaactgctccgggccacccagctccatcagtatgtggagggctttctgttgcatgggctcttgccagctcatgtcattcggttgctgcttaagcctcatgtccaggcccagcaggacttgcagctgttgctggagctgctggagaagatgggactctgttactgcctcaataaacccaagggcaagcctttgaatgggtccacagcttggtacaagttcccatgctatgtgcagaacgaggtgccccatgcagaagcctggattaatgggaccaacctagctgggcagtcttttgtggctgagcagttgcagattgaatatagctttccttttacttttccacttgggttgtttgcacgctacagtgtccagatcaacagccatgtggtgcacaggtcggatggtaaatttcagatctttgcctatagagggaaagttcctgtggttgtgagttacagacctgccaggggagtcctgcagccagacaccctgtccattgctagccatgcatcattaccaaatatatggaccgcatggcaagccataacccccttggtggaggaactgaatgtcctacttcaggaatggcctggactgcactacaccgtgcacattctctgttctaagtgccttaagagaggatcgcccaatccacatgcttttccaggggagttgctgagtcagcccagaccggaaggagtggcagagatcatttgccccaagaacggcagcgagcgagtaaatgttgccttggtttacccacccacgccgactgtgatcagcccctgttccaagaagaatgttggtgaaaagcacagaaaccagtgacgtttgtggctgtggaatttccatggagaaaagagagcatctgaacacctggaccatcttttgcacctggcagaccctctgcactcaccccagcgtgttctgtgaacttgagtgacaacgcgtgcttgcagggtgctttttggacgactggggaagaggtggggagggggtggtggggggaagcatggacgagaacatggagcaaatgttttacaacctgaacctcagaactgtgatcctccaaggagcgcgctacttgaagaaaagaaaaaaaaaaaaaaaaagtcgaatggcttctcagggattttgttttccgtgcacatataagccatagttacagtacaggtggcagtatttagagcactcagatttcagttctgttaaatgtgaaagagggatcgactgacgttcattgctgttccataactagtgtaaaatatgtatatgtttatctttatttttataatatgcaaatacatttaaatttatacagtttgaagcttctagcgttagttcacactgggtgcaatattctgcatgagaactgtgccaagatggggctgatttcttattttagtataagacttttttgttttttctttattctttaatcctcttcacattaaaaaaaaaatctctctgttagcccatggattaagtgttggttcatagagattgccaataatcagaaagaaccttaaatgtgcatttaagacagtgtcccttcccttcttttcaatgaaggtccctgcctatataaatcatctggcacgctggtgggaaatcctttgctcttccaacgtgttattagtgctgggcagagatggggcacactcaggggccaaagaggacaaaaagtccatgcaaaacttgagtcttttaatggcttaagataatcaggagtcagttctgaatcttacaaagtgctctgcttaataagtaccttacttagcagagcactttgcaaacatattacttattagcagagctctttgtagaccttccacatctggctgtcagatcttaaggttgtgaatttaggctccagttacattcactggagagcataatcccacacgggttatttataaatacagagcctctgattggacggtctcctgccaagaactagtaatacccttgttttaaaatcttcacaaggtaaaacttaaaaagccaaccaaacaaattgctctccattctacttttaattgggccaaacagcatatgctacagtagtaacatgtttttcggagagtgtaaaaaactctgtttacatttgcctcctccgtgggttgatcgaaaatgtataaaactgactgcttctcgccagcctcagacaagaagagtgagttgctggtactcgctactcttttacttcttttgtaaagtattgactcttggaaggctacagtatacaaagtctcaacatgttttttaaaagaaataaggagcaagcgactgccctgctagaaatcacaaaccgatttttgtagaatattttgtgccccaggcattaatttcactgactccagaacctgcagttcagagaatgatttcttatgatgataaaaatcgaatgggatcagacgatgtttgcatttttttaatacttgaataggacacctcaagtttgagatttcattttcttttagaacacagtcacaagattaatctggtgaatccttttgtcacagttctcgtgtgtgtgtgcgcgtctccgtgtgtgtgtgtgtgcatgtgtgtaaaactgaatggtcacatttaattgctttttggaccattgaatagttgggaagtaagaattttttaattggcatgagacggttcctcaactgttaaattaaccaactttgacctgtctttagaaaaaggcttatttgtatgattttgggctaactccccggggaccatattaaatgacaaaaatgctcctttgggtgacacaccctacaaagtatttgctgttacgaacataaacgcccacattcttaatatctaatatttttgaccagtgatgttttatgctgtcatctgaaccctagagaagcagtgtcagaggaaaccttggtgtcacatgtgtcttagcaaaagggttaccatgatcgagggtcatgtgaccaaaagatgctccagagaagcttgagaatttgtttcaagttgggaggagggttggagatacaaaaatcactctgctctacaggactcttcagctgtctatgcaagaaattccgttttctctttcagcacctggaaagacacagcagcccaccgaggcgataggtgattcactaagcacaagaggaatgttttctaagcaaggcgtcccttgcctctcaaacaaatgccctccaagtttgttagggtttctattcctgcaacttgtggtatcaaaaccacttcctggaattgtcaaagcactgccaaaataaatgtttttcccccttctaagaaaaaaaaaatgacagtgctcatatttgacacttgtgtattggactctcttttgaatgaataaaaaggaaaaggggtttggtgtaattcctgatggggtgcgtgttgtttttcatgccatggtttgtgaattttaattgtggtttcccatttcgttgttgtaactgggcagaaattaaaaaagaaaaatcaataaaaatacaaagaaatggttaaa

SEQ ID NO: 151372 - DNA, 1130 bp, Homo sapiens
  Payload ID: 9804
  Gene Symbol: MCTS1
  Gene Name: malignant T cell amplified sequence 1
  Uniprot ID: Q9ULC4
  ENST ID: ENST00000371315
  CDS Start-End: 534-1082
taagatcctctttctctctcccccgcccctgccatcctgactccctaaggttttctatagtactatgctctcactcccaacttgaacacttctttaagctttccatccgtagtccttaattgggtttcagtccctccactcccattgttttttctccttacccctctttctcttttgccccctcccccaattctgtctccattcctagggttctaccaatcacatccgtgcactgtgatttagaggcatattctctgtagctgagaggggagccctgcgctcactgccatatgtttattagttatgaactgaataaaggaaggcttgacttcctgggtcatgggagtgaaggagtctgggtgacaggaagcaagcggcctgtcatgcctattgcctagctgccagattaaccttgccttgaaaataacgattgccccataggctattcagtgtaaggaagacaaaaattccttgggaacctactagtgggtttgccttccagatttggtagacgcaaaaagcaaagggggaacatgggcaaaggaagatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatc

SEQ ID NO: 151373 - DNA, 1018 bp, Homo sapiens
  Payload ID: 9804
  Gene Symbol: MCTS1
  Gene Name: malignant T cell amplified sequence 1
  Uniprot ID: Q9ULC4
  ENST ID: ENST00000371317
  CDS Start-End: 258-803
gctacctccaactgctgaggaaccggttgcctaaaaggagccggcaaaagcgcctacgtggagtccagaggagcggaagtagtcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaattctgttagcttcagaaattattttaagttttcttaaactcaagttaaaattgggtagcaaacttggacattaaaaggtatctggtaagtaa

SEQ ID NO: 151374 - DNA, 2056 bp, Homo sapiens
  Payload ID: 9805
  Gene Symbol: MCAT
  Gene Name: malonyl CoA:ACP acyltransferase (mitochondrial)
  Uniprot ID: Q8IVS2
  ENST ID: ENST00000290429
  CDS Start-End: 47-1219
tcgggcctcggtcgccacggtaacgcgcgcgggcaggtgtccgaccatgagcgtccgggtcgcacgggtagcgtgggtcaggggcttgggcgccagctaccgccgcggcgcctcgagcttcccggtgcctccgccgggcgcccagggtgtagcggagctgctgcgagatgcgaccggggcggaggaggaggcgccctgggcggcgacggagcggcgaatgccgggccagtgctccgtgctgctcttcccgggccagggcagccaggtggtgggcatgggccgcggtctgctcaactacccgcgcgtccgcgaactctacgccgccgcccgccgcgtgctgggctacgacctgctggaactgagcctgcacgggccgcaggagaccctggaccgcaccgtgcactgtcagcccgcgatcttcgtggcatcgctggccgctgtcgagaaactacatcacctgcagccctcggtgattgagaactgtgttgctgctgctggattcagtgtgggagagtttgcagccctagtgtttgccggagccatggaatttgctgaaggtttgtatgcagtgaaaatccgagctgaggccatgcaggaagcttcagaagctgtccccagtgggatgctgtctgtcctcggccagcctcagtccaagttcaacttcgcctgtttggaagcccgggaacactgcaagtctttaggcatagagaaccccgtatgtgaagtgtccaactacctctttccagattgcagggtgatttcaggacaccaagaggctctacggtttctccagaagaattcctctaagtttcatttcagacgcaccaggatgttgccggttagtggcgcattccacacccgcctcatggagccagccgtggagcccctgacgcaagctttaaaggcagtcgacattaagaagcctctggtttctgtctactccaacgtccacgcgcatagatacaggcatcccgggcacatccacaagctgctggcccagcagctggtctccccagtgaagtgggagcagacgatgcatgccatatacgaaaggaaaaagggcagggggttcccccaaactttcgaagtaggccctggcaggcagctgggagccatcctgaagagctgtaacatgcaggcctggaagtcctacagcgccgtggatgtgctgcagaccctcgaacatgtggacctggaccctcaggagcccccgagatgactgcagggggctcaaatgcgatgaccccctctgtcctcctgaggagaggctgtaggctgtgcctgtcgccccctaccttcctaatggctcctcctctgaggagtgaaagggatttgtttgcaacgtgctttgaaggccacataaaaagccctaaaaatgagtatttctttacatgacccagtccatttctcccccttggaaaaacgtttggacgttgggaagaatgatgccacagggctggtgtgtggggaagctagaatcctggccccgcctctgccagccctgcaccataggcaggtgtgccatctcagcgggaaggggaggactggctgctgcagcctgtcctgctctgtgagtgctgagaacatgctggtgtggcctcaatttcagccagtgccaggggagcccctccaccacccccagcctgccccccagggctcctttgtcacaaatctgaaaggttttagaacccagttggccttggcagttttgttcacctcctcacttgacagctgggagacagaggcccacatttatggacatacccaagagatatgtattgcctgctgtgtgctagagagtgagtgcgctctgttctggtagaaaggtccttgagtgaggtgcggggtgtggggagtgccaggtagggagggcgactgaggccctggtcctaggggtggaaccatggaggaacaccctggtcacccactgggactgcgggtctgcggggcgccagagggagcacagcacatacctgcctcggagctgacccctggctccatgccccgtcctcagagcagctcctgcgccaatattaagtatgagacattccaagct

SEQ ID NO: 151375 - DNA, 1134 bp, Homo sapiens
  Payload ID: 9805
  Gene Symbol: MCAT
  Gene Name: malonyl CoA:ACP acyltransferase (mitochondrial)
  Uniprot ID: Q8IVS2
  ENST ID: ENST00000327555
  CDS Start-End: 17-559
gggcaggtgtccgaccatgagcgtccgggtcgcacgggtagcgtgggtcaggggcttgggcgccagctaccgccgcggcgcctcgagcttcccggtgcctccgccgggcgcccagggtgtagcggagctgctgcgagatgcgaccggggcggaggaggaggcgccctgggcggcgacggagcggcgaatgccgggccagtgctccgtgctgctcttcccgggccagggcagccaggtggtgggcatgggccgcggtctgctcaactacccgcgcgtccgcgaactctacgccgccgcccgccgcgtgctgggctacgacctgctggaactgagcctgcacgggccgcaggagaccctggaccgcaccgtgcactgtcagcccgcgatcttcgtggcatcgctggccgctgtcgagaaactacatcacctgcagccctcggtgattgagaactgtgttgctgctgctggattcagtgtgggagagtttgcagccctagtgtttgccggagccatggaatttgctgaaggctctacggtttctccagaagaattcctctaagtttcatttcagacgcaccaggatgttgccggttagtggcgcattccacacccgcctcatggagccagccgtggagcccctgacgcaagctttaaaggcagtcgacattaagaagcctctggtttctgtctactccaacgtccacgcgcatagatacaggcatcccgggcacatccacaagctgctggcccagcagctggtctccccagtgaagtgggagcagacgatgcatgccatatacgaaaggaaaaagggcagggggttcccccaaactttcgaagtaggccctggcaggcagctgggagccatcctgaagagctgtaacatgcaggcctggaagtcctacagcgccgtggatgtgctgcagaccctcgaacatgtggacctggaccctcaggagcccccgagatgactgcagggggctcaaatgcgatgaccccctctgtcctcctgaggagaggctgtaggctgtgcctgtcgccccctaccttcctaatggctcctcctctgaggagtgaaagggatttgtttgcaacgtgctttgaaggccacataaaaagccctaaaaatgagta

SEQ ID NO: 151376 - DNA, 459 bp, Homo sapiens
  Payload ID: 9805
  Gene Symbol: MCAT
  Gene Name: malonyl CoA:ACP acyltransferase (mitochondrial)
  ENST ID: ENST00000608052
  CDS Start-End: 1-264
ctggccgctgtcgagaaactacatcacctgcagccctcggtgattgagaactgtgttgctgctgctggattcagtgtgggagagtttgcagccctagtgtttgccggagccatggaatttgctgaaggtacaggaaggagtttggttttatgcaaggctgtggtcttgggctcattaggggtaagggacactgccaaaaatgatactggacccactcaggtgatgggaagggagcacatggacaggggtgacattggcacatgaggacagggctttgctgtgattccttttcaagactgaaggattcattagggatttcccttatttttgtaatctcatgaaatctgcttgctgaactgtctaacccgctatcctgtgcactcatacctgcagcacctgcaacacgagagtatgtgttcagtagatattcgttgaattaaagagtaaataaatattgga

SEQ ID NO: 151377 - DNA, 13038 bp, Homo sapiens
  Payload ID: 9806
  Gene Symbol: MLYCD
  Gene Name: malonyl-CoA decarboxylase
  Uniprot ID: O95822
  ENST ID: ENST00000262430
  CDS Start-End: 20-1501
gcagctgttgtggggcaccatgcgaggcttcgggccaggcttgacggccaggcgtctcctcccgctgcggttgcccccgcggccgcccgggccccggctggcgagcgggcaggcggccggcgccctggagcgggccatggacgagctgctgcgccgcgcggtgccgccgacgccggcctacgagctgcgcgagaagacaccggcgcccgccgagggtcagtgcgcggacttcgtgagcttctacggtgggctggccgagacggcccagcgggccgaactgctgggccgcctggcgcggggcttcggcgtggaccacggccaggtggcggagcagagcgccggcgtgctccatctgcgccagcagcagcgggaggcggcggtgctgctgcaggccgaggaccggctgcgctacgcgctggtgccgcgctatcgcggcctcttccaccacatcagcaagctggacggcggcgtgcgcttcctggtgcagctgcgggccgacctgctggaggcgcaggccctcaagctggtggaggggccggacgtccgggaaatgaatggggtgctgaaaggaatgctctcagaatggttttcctccgggttcctgaacctagaacgggttacctggcattcaccgtgtgaagtgcttcagaaaatcagtgaggctgaggctgtgcatcctgtaaaaaactggatggacatgaagcgccgcgttgggccctacagaaggtgttacttcttttctcactgttcgacccctggggagcccctggtcgttttgcacgtggcactgactggtgacatctccagcaacatccaggcaatcgtgaaggaacatcctccatcagaaacagaagagaagaacaaaatcactgctgcgatcttttattccatcagcttgacccagcagggactccaaggggtggagctgggaacattcctcataaagcgagtcgtcaaggagttgcagagagagtttcctcaccttggggtgttttcaagtctgtcacctatacctggtttcaccaaatggcttctggggcttctgaactcgcaaacgaaggagcatgggaggaatgaactctttacagattcggaatgtaaggaaatctcggagatcacaggtggccccattaacgagaccctcaagctcctcctcagcagcagcgagtgggtgcagtcggagaagctggtgcgggcgctgcagactccgctgatgaggctgtgcgcctggtacctgtatggagagaagcaccgcggctacgcgctgaaccccgtggccaacttccacctgcagaacggggcggtgctgtggcgcatcaactggatggcggatgtgagcctcagaggcatcaccggctcctgcggcctgatggccaactaccgctacttcctggaggagacgggccccaacagcacctcctacctcggctccaagatcatcaaagcctctgagcaggtcctcagcctagtggcccagtttcaaaagaacagcaagctctgacagtaaacctctcctaaagcacagggccccggctaagaaaacgatcattttcaggaggggccgggagttatgtatctgaagcagctttccaagcaaagccaaagttgactgtgttcttgtcccgcagccggtccacactgtgaggccaggcctcaacttccctcaccctgggcgtgacatgcacccagtgcaagacggttgtgggtgcgggtgcacacaaatgagtgggttgctgtgctgtctccggaagattctgtcgttgcccttggcctggctccctgcccggggctggtgctgtggtacctacatcttcaggaagctgtgcagcctctgccattgccatcccagggggatctggcatcctcctaaggaccggggcgcgtggcccagataagaataggtgttcctttgtgctcataaaacagaatgcggcgatggttgctttagccgtttctcaccatgcaatgcagagggacaaagggctgtgctacacttcccagttacattctgaagctcataaatgtatgagaaggtttgtgattttgcacaaggtgtgtgtagtaagttaaattgttgaacacaaaaatgttgctgcttgaggcataagttggataataggctttaaatgatcagggattcaggttcataatgaacttcacagtaaagaacacgtttgttctgtaaagcattgaacatctgattgtgtagtggtggtcgtctttaagattagagacctgggaaggctggaatcagccagccagcctacggggagtttgggatgaaggagcctggggtgtgttggatgagaacaaaggtgaaggaaggggcagtcattgtgcttgtgggaggaaggcagttgtgtttgtgtgtgtatgtgtgtatcagtgcacatctgtgtgcatgtgcacgagcgtctctgtgtggatcagtgcacgtctgtgcgtgtgcacgagcgtctgtggatcagtgcacgtctgtgtgcgtgtgcacgagcgtctctgtgtgtatcagtgcatgtctgtgtacgtgtgcacgagcatctctggatcagtgcacgtctgtgtgcatgtgcccgagcgtctctgtgtggatcagtgcacgtctgtgtgcgtgtgcacgagcgtctctgtgtggatcagtgcacgtctgtgtgcgtgtgcacgagcatctctgtgtgtgtcagtgcacgtctgtgtgcgtgtgcacgagcgtctctgtgtgtatcagtgcacgtctgtgtgcgtgtgcccgagcgtctctgtgtggatcagtgcacgtctgtgtgcatgtgcacgagcgttctatgtggatcagtgcacgcctgtgtgcgtgtgcacgagcgtctctgtgtgtcagtgcacgtctgtgtgcgtgtgcccgagcgtctctgtgtggatcagtgcacgtctgtgtgcgtgtgcacgagcgtctctgtgtggatcagtgcacgtctgtgtgcgtgtgcacgagcgttctatgtggatcagtgcacgcctgtgtgcgtgtgcacgagcgtctctgtgtgtcagtgcacgtctgtgtgcgtgtgcacaagcgtctctgtgtggatcagtgcacgtctgtgtgcgtgtgcacgagcgtctctgtggatcagtgcacgtctgtgtgcgtgtgcacgagcgttctatgtggatcagtgcacgcctgtgtgcgtgtgcacgagcgtctctgtgtgtgtcagtgcacgtctgtgtgtgcacgagcgtctctgtgtggatcagtgcacgtctgtgtgcgtgtgcccgagcgtctctgtgtggatcagtgcacgtctgtgtgcgtgtgcacaagcatctgtgtgtgtcagtgcacgtctgtgtgcgtgtgcacgagcgtctctggatcagtgcacgtctgtgcatgtgcacacgtgcatgtgcatgtgcttacacgtctttgtgtgtctgtgtgcgtgtgtccgcagttgccctgtcctcgctgtcctcggtttggcagacaggtccctcaccttccttgcctttcatctcctgtgaccctcgccaggccccttctctgtcttctgcgtacggcgtgttgcttcgtgacagacggtgtgatcgcgggagctgtctcatgcctcttgttctccgggctgattctgaaagagtggcttgcaggccaatcaatgcaatcctggcaacctgcccgcccttcttgcgggcagagttctttaccgtaagcgtccccagaccctcaggcctgcggaaacctgctgggccttaccgtctttgcttagcttttggcctagaccttaaagaccagcagtcttctgtgctttatcctgctgcctccagagtgccatggacagatcacccattctcgatcactccggcagcctttcggatccggtggcgcccttcctggctgtgtccttcacctgtgctgtctggttctctcctgtgtggacaggggatgataggaattcccgctgcacaggccgctgggaggacgggctcaggtgacatctgccgaggctttggctcaccagaggagtttgtagatgtcagtcatccccaagtcactaggaactagcacgcctgaggtaggtctcggaatagtgttcaaatccattttactattgcggccaaggagccctccctccagcaaggcggctcatcacatcacgttactctttaggtcaaatgtaaccctcccggttttatttatcactcaggcagagtttcttaaccttttgtgagttacagatcactgaaattctggtgaaagccaggtaggcctcgccgcaggagaacacatacatggtgcacagaacacacacagtgcacagaacacagtgcacaggagaacactcacagtgcacaggagaacacgcacacggtgcacaggagaacacgcacacatgttgcacaggagaattcacacacagtgcacaggagaacacacagtgcacaggagaacacatggtgcacaggagaacacgcacacacggtgcacaggagaacacacacagtgcacaggagaacacgcacagtgcacaggagaacacagagtgcacaggagaacacatggtgcacaggagaacacgcacacacggtgcacagaacacacacagtgcacaggagaacacgcacagtgcacaggagaacacggtgcaccggagaacatgcacacatggtgcacaggagaacacagtgcacaggagaatacagactgcacagaacacacgcacagtgcacaggagaaaacgcacacacagtgcacagaacacagtgcacaggagaacacgcacacagtgcacagagaaccacacagtgcacaggagaatacgcacacacagtgcacagaacacagacacagtacacaggagaacacgcacacacagtgcacagaacacagccagtgcacaggagaacactgcacaggagaaccacactgcacaggagaatatgcataaacagttcacaggagaacacgcacacacagtgcatagagcacagacacagtgcacaggagaaccacacaatgtacaggagaatacgcacacacagtgcacaggagaacatacacgcagtacacagacacagtgcaccggagaacacagtgcacaggagaacacgcacacacagtgcacagaacacagacacagtgcacaggagaacacacagtgcacaggagaacacagtgcacaggagaatacacacggtgcacaggagaattcacacacaatgcacaggagaacacagtgcacaggagaacacacacacacactgcacaggagaccatgcacagtgcacaggagaatacacatggtgcacagcagaattcacacagtgcacaggagaacacacacagtgcacagaattcatgcacacagtgcacaggagaacacacacagtgcacaggagaacacagtgcacaggagaacacacactgcacagaacaaatgcacagcacacaggagaacatgcacacacagtgcacaggagaacacagtgcacaggagaacacacagtgcacaggagagaacacacagtgcacagaacacacagggcacaggagaacacacagtgcacaggagaacactgcacagaacacacggtgatcagaacacacagtgcacaggagaacacacagtgcacagaacacacggggcacaggagaacacacgatgcacggaacacggtgatcagaacacggttcacaggagaacacacagtgcacagaacacacggggcacaggagaacacacagtgcacagaacacacagtgcacagaacacacggtgcacaggagaacacatggtgcacaggagaacacacggtgtacagaacacacggtgcacaggagaacacgcagtgcacaggagaacatgcaatgcacgggagaacacagtgcagagaacacacacgcactgcacagaacatgcagtggtgcacaggagaacagtacacaacaacacattccatgcacaggagaacacacgcaattcacaggacacaacagaacacacgcagtgcacaggacacaacagaacacacgtgcacaggagaacacagtacacacacagcgcactggagaacacgcacagtgcacaggagaacagagtgcacagaacacagtccacaggacagcacacggtacacagcagaacacccgcagtgcacaggagaacctagtgcacagaacacacaccctgtgcacagttttgttttgttttgcttttgcaattccagggagctccctggcctcccacagccattcatagagcccattctgtttgcgataaaaacagatctcctccagctcacgtgaggctaggcacgggttcctcaaaacctttttgggcagctagcagctttgactagcagctcatctcaccaggctgaggtcgctgcctgtgaacagttgacagacctaaagccagccagaatgttctgtgtcagagagccctgtccaatgggcagagctgggagacacgcaggaagacccccagcccatgcccgttctcaggcctgaggttcattctcgttctctccctcttccctttccccttcctccctcctgccctcgaatctgcaaggtctctccgggtggctgtgttctgccagggcctcccaggctccaagatcactgccttcagggagcccaggaagagctgcacatccgctgcctctgtgtggcaggcgtgtccgagactgcaactcctagttcccacctttcacacctcatctctctaacctcttatggaaaatttcaaacatatgtaaaagcagggagaaattgcataacgaacctacagacctatcacccagcttccacagtcatcagtggttttctgtttttatcaaactttatctttgtacttcttacagtgcttcacatttagcaggtcctcaatgaacattagatggatggatggaaggaaggaagatggatggatggatggatggatggatggatggatggatggatgacagatggatggtggagggttaatggaaggaaggaagatggatgggtggaaggaagatgggtggatggatggtggagggtggatagaaggaagatgggtatatgaatagatggctgggtgggtggaaggaaggaagatggttggatggatggaagatggatggatggatggatggagggtagagttttaatggaaggaagatggatggacgaatagatggaaggaagatgggtggatggaaggaagatggatggatggaatgatggatgggtggtagagggtggatggaaggaagatggatgaatagatgggtgggtgggtggatgtttggatggatggtggagggcagagtgttaatggaaggaagatgaatggatagatggagggtagagtgtagatggaaggaaaggaaaggaggatggatggatggatggatggatagatggatggaggagggtggatggaaggaaggaggatggatggatggatgggtgggtgggtgggtggatggatggcgcagggtatatggaaggaagatggatgaatgatggaagatggatggatgggggacagatgaattgatggcggaggatgttaggatgggtggatggatgtattaacatcccttctccatgcctcagtccccatcataaggagaaagagcctgtcgtccctctatgatactgcactgaaccaatattcccctcacttcatgggtgttacaaacctcttatcatctgtttacgtctcactcttactgtagaacctctagaaaggcaggtggcttccagctcctcgcttttcctgagggatgatctgaccacccattcttacacatgtcatctttcccacagtggcagtgcagaggagacaaaagcagaacaaaagcagacagcggccaggtctgagggtgataggctactcactgggtcctagtgttctgaactacaccctacaggaaagtgctactcagtgcccaggtgacatcgtcacaaggggaacacagtggctaagagggcaggggctcagtctcacagacctggtttccatcccacttgctctcaggaaccctgggcaacaactgtgaccacagtgtcttcctctggaaagtgcccagcagtgttgggctcaccgtagctgcacaataaattgtcatgagtgctttccactgtgtcccaggttcaaggctgaagtcacaaccccacccctgccacagagcctgcccccccgagtgttccccatctcagtctgaggcccgacctgtgcttccggagcccgcgtcccgtcccatctcaggagctactctgctccattccccccgtatccgagacctaagttccggctctccttatctcttggagccctgtcatctgtggatcagatgctccccagctccctccatcccacccacagggtttcacaagaggcccagccatgcaccctgctggggttcagacttgaggggtgccactggagttggggtgcacctgctctcacctgttcatgggctcctttttcttctgaaatgcagcgtgaggcaccatggagggagctgtagactttggctccggccagtgcccagttcaaatgctggccccaccacttccagctgggtggcccagggcaagccacctacccttgctttgcctcagtttcctcatctttaagtggcagtaaccatagtaccgaccccacagcctgctgagaggctcaaaggagacgatgtatataaagcagttaactgatgcctgccctgggaagcagagcagtccctgtcatgatgggcgtttctacatctggacctgggcgccaccatcctgctcacctgaatgcgggttctgggatctttcagtccttatttggatatttgaatatttgttggttttctggcttctcacaatttctaagaggtgactaagtggatcattcgttcccgggagaggtgggaatggctcctgtggacacggcattgcacaggggcttgaggggacctcctgacccctgatggctgagcacccttgtcatactcctcagggagagcccaggccaccggctagctccagactggctctgcagggcctcagaatctgaactccctgtggtcactctgaggcctctctgtctctctgtgtctttctctttctaccctctccatccctccttccctctgagggcttgaccttcactgacctccagggcaagaacaaccaagagttgctcccaagagggcttccctcctcctcgttctgtgtggcctcagaagtgagggaatctcagtgctctgtgcaggcatgtgcttattctgagctctgtttgaaattaaacatgaggtgtactaaagatttaaatcgagcaaacacctctgtgatttccaattggattctgaggcgcttacagaaatatgaagtccattttgatctactcttagaaacaaaagctgcccatgatttcaccacagaaagtctgcctcatttgcagtttagcggactcacagaggtgaccctagatctctgtctcgcctttgtttggtttatttccacattgcatttgcgtttcccgcctggctagttcttgatcattgaggaaggcagagagaaacgagattctctgctctgggccaggcattctctgtacacgttcctggttccagcctgcctccttccctagaggatcaccgtgtccagccctgaagctggagcgagtgttcctcacttagagatgaggcgatgaggcggcgagctgggagagggctgagcagctggtgagggcagagttgggactcaaacccaggcccgaccaccacccagctctccttccaccgcactggtccacctcctgaccgtacgtggggagacccacgcaaaggcccagagaggagaaggccagcagtgggcagaacagagtgggccgcaggttttggcaagcctggaggggaataggtcagaaaggtagcccggctgggctgagagactgaggacagggggtgttagggtgctgacattctggcaagggggcgggggtctgtggaagacaaccccaggctggggtggcttctctcaaacccgggcatgcacagtgctggccgtatcggtccgagccctcggctgccagggagagaagctgagctcccaccaaagcataaaatccaggccagcgaggggcagccagaccacgggaagacaggaggaacccggacctggctctcgtgcaggaagcaggcagtgcacagctccgccgccacagagacagcctcctctcatgaccccagactcagcccgggccgtggtgggaacgatggttggcccggtttggagatgggggatctggccctgtggtgagtgcacccagagcaggtgtctctccggagcagttgagtagaacagctggcgtcacctcttcatgttgacgaggggagatgagtggcccaggcagttcctagagcgggggagatggagtgggccgtatcccacccagcaggagcgcttgcttctgaagctcccgtgcgtctgtgacagaggcttgaacccccggcttgttctctcacgtctgttgccgtaaatctgtctccatcgcctggcacataggagaggcttggcaaatatttttggttcactgaagaaaggcagccctcactcctgctgctcagacagcaccccctgaacgtgagttactgcctccttgagcactttcgcaggagagaagaccagagagctgccttcaaagatgccagagccatgtttatttaagcggcgctgctccagagagaactggccatttgcagtctccaccccagtgtggctcacgatgccacctctccttgccagctctcaccgaggcccccggtgacctcctagggggtacatccagccaggttccccctcagcaatggccaggggccaccgtgggccacactgcacttcccaaatgctcccggcactggcacagatgcacaccctcttggccatccccacctgtgctccgccactcttagtcagccattcctctcggcttccgggagtcccctccttctctaaggatctcacccccatccgtgtctctgctgtctcctaactaccgatagcaagggcactagtgcccctgtttgccggggacaggccctgtctggggccctggtgtggcatcattgttaacagagcttcttttcactctgaagtgttcagttaggacagtcacttgcacagtcccctcactggtgacacagacaccccatacctgtgtgtttcccctgcatagctcagcagcagctcaggctcagcacggccaaggctgaatgcagatgccctccctccaaaacctggcctcctccagctgttccttcctggcgaggccacctccaactgtgtaacacagaagcctgggtgccatccctggggctcccctcacccccacctcccacccgtccccgggcccctggacagaccactggccttgttctcttcatttccctggcccaggttacaaagtctccttcctgattatgtgcattaactaacctcgcaggtgctctgcccacctgcctacgccagactcttccagatccttctccaccccagcaggcagagttgtcattgtgaaatgcaaatcaggttccatctctcctctcctttcctacctcccaccatccccgtcaccctccctgtcacacacagccccctccgtggcctctcaagcctgctgtggcctgaccctcccctctgcttttccaggccctcctggcactgtcctccctcagtctgggactccctgtcctccctccttcctgcgtggcacatgctcctccctcttcttgaaacgctctcccctccctgcctcccaggcaatgcccactctgcctccaaagttcatccatcgtcctctcctcaggaagatttccctggtggcttgactaggtcacagtccccctttatttgccgtcttctcactggggcctctccttcctggtagcttctaaacaaggcagtttcatgtgtgtatctccactagactagacgctctctgagggcagggaccctgcttcgcttctggcccgaggtggctgcagggtctgcaagatcatcagggccccctccaatgtgacacttgcagaggggacccctggcctggggccacgctggttacttgggtacactccttgcccagggttccacagccccttaaaggcagggtctttctggccacgcctggccctggtctggcctccccaaggagccctgccgctgggggtgctgtgtgggaacagagcacaggccctccctcccagagcccacgagatctcactttctccaagcccagctccccaaggactcagaccccagttgccctgcactgaacgctggcttgccctagctcactcggaccccaccctgcactgggaaggagggtccctgtccccgtttgacgggtgacgacactgaggcccagagagctgaaggggctggccgaggggacgggcttgggcgcttccattctcacactgctgccgtgacacctaatccatccggggaagttccctttaaacccaaaaggggacggtgaagccacacgcggccgcccttctcaggagcccacttccacctctcgcaggctagacagcgttccccaagtccccccttgagctgggtgggctgcccagctgtgaacacaaggacacctccgatttcgtcctgtgaatgttgatattagtggtcccttccttcaggggctgtggggatctcaaaagataaggcaggtctggagtcctgcgcggtacctgccgcatggcaggctctttacggacagcgcagggacgcactttgatgctgaaaatgagtctctgggacagatggatcccagtctgggtcctcgcaagcgctgtgcaccccgtcgccgcgagatggcggtgttgcgcccctccagcctcctctgctctgcgcttgggcgctgaatgttaaaattcctaacaggtgaatcgcttgaatccgggaggcggaggttgcagttggccgagatggcgccactcactccagcctggcgacagagcgagactacgtctcaaaaaaaaataaaaataaaaaaataaaat

SEQ ID NO: 151378 - DNA, 2866 bp, Homo sapiens
  Payload ID: 9807
  Gene Symbol: MALT1
  Gene Name: MALT1 paracaspase
  Uniprot ID: Q9UDY8
  ENST ID: ENST00000345724
  CDS Start-End: 113-2554
gttcttccgcccctgcctccgcggctcggaggcgagcggaaggtgccccggggccgaggcccgtgacggggcgggcgggagccccggcagtccggggtcgccggcgagggccatgtcgctgttgggggacccgctacaggccctgccgccctcggccgcccccacggggccgctgctcgcccctccggccggcgcgaccctcaaccgcctgcgggagccgctgctgcggaggctcagcgagctcctggatcaggcgcccgagggccggggctggaggagactggcggagctggcggggagtcgcgggcgcctccgcctcagttgcctagacctggagcagtgttctcttaaggtactggagcctgaaggaagccccagcctgtgtctgctgaagttaatgggtgaaaaaggttgcacagtcacagaattgagtgatttcctgcaggctatggaacacactgaagttcttcagcttctcagccccccaggaataaagattactgtaaacccagagtcaaaggcagtcttggctggacagtttgtgaaactgtgttgccgggcaactggacatccttttgttcaatatcagtggttcaaaatgaataaagagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagcttccagagaagtgttgatggcgtctctgaatccaagttgcaaatctgtgttgaaccaacttcccaaaagctgatgccaggcagcacattggttttacagtgtgttgctgttggaagccctattcctcactaccagtggttcaaaaatgaattaccattaacacatgagaccaaaaagctatacatggtgccttatgtggatttggaacaccaaggaacctactggtgtcatgtatataatgatcgagacagtcaagatagcaagaaggtagaaatcatcatagatgaattaaataatcttggtcatcctgataataaagagcaaacaactgaccagcctttggcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatgggttattatattatgcaggacatggttatgaaaattttgggaacagcttcatggtccccgttgatgctccaaatccatataggtctgaaaattgtctgtgtgtacaaaatatactgaaattgatgcaagaaaaagaaactggacttaatgtgttcttattggatatgtgtaggaaaagaaatgactacgatgataccattccaatcttggatgcactaaaagtcaccgccaatattgtgtttggatatgccacgtgtcaaggagcagaagcttttgaaatccagcattctggattggcaaatggaatctttatgaaatttttaaaagacagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgaagaaactggcagctacttggtatcaaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcat

SEQ ID NO: 151379 - DNA, 9368 bp, Homo sapiens
  Payload ID: 9807
  Gene Symbol: MALT1
  Gene Name: MALT1 paracaspase
  Uniprot ID: Q9UDY8
  ENST ID: ENST00000348428
  CDS Start-End: 259-2733
cgaggctccgtgccccgccccccgggtgccccgcccctttgcgcggctggcgcggccagcaggccaggctcccctcggcaaacctgtctaattggggcggggagcggagcttcctcctctgagggccgtgccgcgctgccagatttgttcttccgcccctgcctccgcggctcggaggcgagcggaaggtgccccggggccgaggcccgtgacggggcgggcgggagccccggcagtccggggtcgccggcgagggccatgtcgctgttgggggacccgctacaggccctgccgccctcggccgcccccacggggccgctgctcgcccctccggccggcgcgaccctcaaccgcctgcgggagccgctgctgcggaggctcagcgagctcctggatcaggcgcccgagggccggggctggaggagactggcggagctggcggggagtcgcgggcgcctccgcctcagttgcctagacctggagcagtgttctcttaaggtactggagcctgaaggaagccccagcctgtgtctgctgaagttaatgggtgaaaaaggttgcacagtcacagaattgagtgatttcctgcaggctatggaacacactgaagttcttcagcttctcagccccccaggaataaagattactgtaaacccagagtcaaaggcagtcttggctggacagtttgtgaaactgtgttgccgggcaactggacatccttttgttcaatatcagtggttcaaaatgaataaagagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagcttccagagaagtgttgatggcgtctctgaatccaagttgcaaatctgtgttgaaccaacttcccaaaagctgatgccaggcagcacattggttttacagtgtgttgctgttggaagccctattcctcactaccagtggttcaaaaatgaattaccattaacacatgagaccaaaaagctatacatggtgccttatgtggatttggaacaccaaggaacctactggtgtcatgtatataatgatcgagacagtcaagatagcaagaaggtagaaatcatcataggaagaacagatgaggcagtggagtgcactgaagatgaattaaataatcttggtcatcctgataataaagagcaaacaactgaccagcctttggcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatgggttattatattatgcaggacatggttatgaaaattttgggaacagcttcatggtccccgttgatgctccaaatccatataggtctgaaaattgtctgtgtgtacaaaatatactgaaattgatgcaagaaaaagaaactggacttaatgtgttcttattggatatgtgtaggaaaagaaatgactacgatgataccattccaatcttggatgcactaaaagtcaccgccaatattgtgtttggatatgccacgtgtcaaggagcagaagcttttgaaatccagcattctggattggcaaatggaatctttatgaaatttttaaaagacagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgaagaaactggcagctacttggtatcaaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcattattgtagaataagtcattgtatttttaacaccagaaagaaccttgccgatcaccaggcataacctaattttatccatggaagaaacacagaaaggcatctaagttagagctggcaccagaactgagacctccagaaatctattccagtattttttccactacacaactgccttcctgacaggttctgagataagtgttatgtttgtagatagagtgaaatatatttatatatatataaatatatacagatacatatctgtgtattatctcaaggaatgtacaaactttagtttttgattataaggacttcactgcaagttttagttaagaggtttgtatataaatctgttatagaacaggctgaaatttcttgttcataagattatgaaaccacatgagaagtgataaaatgtttgttaaagctagatagaggttaagaatcaagatataatggataattttcatagctgcctatcagaatttcccaaatatttagcatcttccttgataatatgtattttcttcttgaatttcactggcctaatgagataatactcttatctttggctctacctaaaagttggttaaaaatgcaattggcattaacaaggaaaaatactgaattagtaattttaaaagtctcacaaagaaaatcccaggcctagatggctgcattgttgaattctgccaaacattaaaattagcactaattttttgcacactgtttctaaaagtaggagaggaaagaacacttcccaacttactctaggtcagtattaccctgatactagactagacatcacaagaaaactataagccaatattccttattaatacaaacacaaaaatcattaacaaaaatattagcaaactgaatccagcaacctataaaaaggattctatatcatgaccaagtggaatttatcccaggaattcaaggttggttcaacatctaaaaatcaaataagctaatatacagtcagttctcattattcacagtaattatgttctacagaatattctcccataaacactgaattaaatatggaacaactgcttttaggagaaagtgtatttgtgtatatgtgtgtatacatatgtttatctcacacacattatgagcttgaattcttaattcatcctagcaaattctaccttattttacagaagtgaaagtgaggtatcagaagtgttaagtgacatgcctgaggcacccccctaacaggtgtcagagctgaaattcaaaccccatccagctggccccggagccagagcttcttgtactacacagaattgcccctgccatttccaccctccagtcatttctctatgagactgaagcaggaaggcagagcatcatcttgttcagcctcagctgggaacatgtgtactgggtgactcaaatttttcacccatttacacatatccacaaatgactgcaaaagtgccacggatatcaatttgagggttataaattttagcaagttggtaaattcacaaatacataaccttgaataatgaggatcaactgtaccatatttaataaagcacaaaacccacacagattgtcttattacagcatttgataaaatccaaaactctttcataaaaacactcaacaaacttaggaataaaaggaatcttcctagatatgataaatataacatctatgaaaagcccacacctaacattatacttcatggtgatagactgaaggctgaatgttttccccttaagattgggaagaaggacaaggatgttcactcggcactacttctattcagcattgtacttgaagttctagccacagcagttaggttaggaattcaaggtttgttcaacatctaaaaatcaaataagctaataaagaaaagaggtttatactgcaaaagaagtgaaactatatgtattcacagttgatacatagttgtatatagaaaatgctaaagaatccataaaaagtaataaatgagttcaacaggttgcaggatacaagatcagttttatttctctactaacagcaaacattctgaaaatgagaataaagaaatcctatatacagtagcatcaagaataaaactccaacacgtttaaagaaattaagatccagataaatggaaagacatccatgttcatggattggaagactgaatattggtaagatggcaatgctgcccaaattagtctacatattcaacaattcctatcaaaatcctagctgtattttttgcagaaattgacaaactggtaaaattggtagggaaacgcaggggacccagaatagccaaaaaaccttggaaaagaacaaagttggaagacgtaccaatttcaaaaagtgctaccaagctacaataagacagtgtaggcatatggatagacatatcgatcagaggaatggaactgaacatccagaaataaacccatacatttctggtcaacttgttttcaacaaggatgccaataccatcaatagagaaggagtggtcttttcaacaaacggtgctgggacaactaactggtagctacgtgcacagcaaaaggatccctaccttcctaccacattacaaattctaactcaaaatggatcatagacctcaatataagagtttaaactcttagaagaaaacagaagtaaatctttgtgatgttgggcttaggaatggtttcttagacataataccaaaagcacaagcaacaaaggcaaacagtagataaatgggacttcatcaaaattaactttagcgccttaaaggacaccattaagaaagtgaagttaaccctcagaatgggagaaaaatttttgaaaaatcatgtatctgataaaaaaacaaacaaacatgcaggtgctcagctgtggttaccaccgagcagcactgtccagtgaacttgctgtgatgatgggatgcttggtatccgcactcccagtgtgatagcctttagcctcatggggttgttgagcagttgaaataatagctagtgtgaggaactgaacataaaattttagttttaggatgggtgtggtggctcacgcctataatctcagcactttgggaggccaatgaaggcggatcacttgagcccaggagttcaagaccagcttgaccaagatggcaaaaccctgtctctattaaaaatacaaaaaaattagctgggcatggtggcacacacctgtaatcccagctactagggaggctgaggcaggagaatcgtacttcccctttatactcttctgtatatttgatttttttttttttaagacagagtcctggctctgtcgcccaggctggagtgcagcgacatagtctcagctcactgcagcatccgtggaggctgaaacaggagaatcgcatgaattttttaaaaaatctaaacatgtaattttaaaacgggcttaagaagaatgataacagttttggtcttcttttttatcaaccatgcttttattttacttgaatctcgtgccaattgctttgtaatattaaagtaggatttacacaagtggaatttagaaaagatgataatctatcaaatctgtcaataccaattagaatgtaataaagaaattaggatagtggaggtttgagcaagtaaaggctcacccaaattcaaagccaatacttgatgctgagaggggatattttctggaaggtaatttttaaaaattaaagtcacaattataaattgtatatttcctaataaaagaaatctcaactcatgggacaatttgaatttaaaacactattgttcctcattcagtgatgaacaagtcaaaacgtttcagaaaagaaagcctttaaagaagaatcctggcacagaaaaggtccatttagacattgccttcttcccccatctctaatgcctcttttcaaatctctgacttgcacatgaagtaacagtgaggtgtcctgtgcagcagtcgcaattttttgacttgtcaaattgaagaaattcaattatgtagccagagcttagatcactgacatgtatactggcataagcttttttttgtttgtttttaattttattagaagtgggatctcattttgttgcccatgctggtctcaaacacctgtcttcaagtgatcctcctgcctcagcagcatcagtttaatatctagataaaatctgatgtatgtaattttacttttaagggtttttttccaaacagacgtcctgacaatgttgtttcctattccttgaacattcacctgacgcttatatactgtcattacttttatctgtcaactgatgtcagctactcaatttacacattacttttgtgcatttcatcctgtttctcagtttgacattgtcattcaaattcagagtttgacactgaaaccctgggcatggtggctcacacctgtaatcccagcacttcgggagactgcggtaagcagatcatttgaacccaggagtttgagactagccttggcaacatggtgaaaccccatctctaccaaaaaaaaaaaaaaaaaaaaagcaaaaacaaaaattaactgggcatagttgcacacacctgtagtcccagctactcaggaggctgaagtgggacgatcgcttgagcccagaaggcagaggttacggtgagtagagattgtgccactgcactccagcctggacgacagggcaagacgctgtctcaaaaataaaatattagtaaagaagagtacaatcagaatatgaaaatgtgtaaatgtgcatattctctttttttctaatttggtagcattaaaaatacttaagcatcaaagtttggctttatgaagaaggagtctgagacacctcaggtttcagcccttactaatagcgtggctcaaagagcgttaacttgcctgtgcttctgtttccttatctgtaaaatggggatgatgctgtaacatcaaagagcttataatactttccagagctggcagtactaaataagaccattcctctaaagtgccagcattttgaaaagcatcaacccatcaaccttgtgctttaaatctggcattcttaaagctatacctgtaggcagtatagagtgtttttttttatttgtttttttgttgttgtcttttgagtctcactctgtctcccaggctgtagtgcagtggcacgtcttggttcgccgcaacctccgcctcccaggttcaagcgattctcgtgcctcagccccccgcatagctggcattacaggcacacaccaccacgcccagctaatttttgtagttttagtagtatctactaaaataaacagggtttcaccatgttggccaggctggtctcaaactcctgacctcaagtgatctgcctgcctcggcctcccaaagtgctgggattacaggcgtgagtcaccatgcccggccggcagtgtatatcttctaaagttgcaatttttgttcactccagaatcacttttcaaaaagcatgcagatttaatgccaccagtttgtgttatgtatctatcccgcaaaacagctctaaaggtgatttactaaaagattaacagcatttatctctggtgggataatttttctttgcttgtttacctgtgtcttgcagattttacacagtgaacaatgactgtataattttaaaatacagatatgcacaattgtgtaatgtaaatatgctcagcttcaatacatttaagaacacatttttaacttttcgtaaggagtcttcagtttaaaagtacagtgtcattacagagtgcttattctgttacaaaattagtaaagctgattctgcctctaaatctgaagtaattcccactttttttcatgcttgagtttagttgataaatagcattttagatactaaaaatgattggatgagtatttctacattaataagttgctaattaggcaccagggtagcagatagaatgcctttctgtgtgctaggtttaaacattttacacacagtcttatttaaaacagccttgcagtttatagatgaactgattgttaggctaaccagaggtgttactataccctccaggataacccagctagtaagggcagagccaggatgattcagacccagaccagagccgggtgttttgtccacagtactgctgctgcttataccgtaacgggaaaagtacacaacagtgtcttaatatttcattcttccatgaaaaacacttttaaaatattgaaacattataggagcagaagtacatctctaaatatacttttaggtcacattgaaaacatttccaaaggatttgacctgaagttaatgttgctacattatgctcaatacagcaggctgttctgctagggaaattgttaatattttaaaaatattttcctaagctttagctttacca

SEQ ID NO: 151380 - DNA, 565 bp, Homo sapiens
  Payload ID: 9807
  Gene Symbol: MALT1
  Gene Name: MALT1 paracaspase
  ENST ID: ENST00000591792
  CDS Start-End: 207-565
agaggacttaaaatgcaaaagaaagggatgtggacactgctctgggagacctaaggaaggctgggaagaagcgcaggcgaggtgatgaatgcagagggtggggtgcaggaattcatgaacattttgcaagttgcctagacctggagcagtgttctcttaaggtactggagcctgaaggaagccccagcctgtgtctgctgaagttaatgggtgaaaaaggttgcacagtcacagaattgagtgatttcctgcaggctatggaacacactgaagttcttcagcttctcagccccccaggaataaagattactgtaaacccagagtcaaaggcagtcttggctggacagtttgtgaaactgtgttgccgggcaactggacatccttttgttcaatatcagtggttcaaaatgaataaagagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagctt

SEQ ID NO: 151381 - DNA, 582 bp, Homo sapiens
  Payload ID: 9808
  Gene Symbol: MGAM
  Gene Name: maltase-glucoamylase
  ENST ID: ENST00000497673
  CDS Start-End: 154-582
attgctaagccatccttcagacagagagggagcggctgcaagaggtaatgagcaacatggatagacctggaggctattttttctgcgtgaaatgacccagaaacagaaagtaaaaaactgcatgttctcacttatacacgagagataaacaagatggcaagaaagaagctgaaaaaatttactactttggagattgtgctcagtgttcttctgcttgtgttgtttatcatcagtattgttctaattgtgcttttagccaaagagtcactgaaatcaacagccccagatcctgggacaactggtaccccagatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggccacatgtgaccaacgtggctgttgctggaatccccagggagctgtaagtgttccctggtgctactattccaagaatcatagctaccatgtagagggcaac

SEQ ID NO: 151382 - DNA, 9172 bp, Homo sapiens
  Payload ID: 9808
  Gene Symbol: MGAM
  Gene Name: maltase-glucoamylase
  ENST ID: ENST00000475668
  CDS Start-End: 55-8316
attgctaagccatccttcagacagagagggagcggctgcaagaggtaatgagagatggcaagaaagaagctgaaaaaatttactactttggagattgtgctcagtgttcttctgcttgtgttgtttatcatcagtattgttctaattgtgcttttagccaaagagtcactgaaatcaacagccccagatcctgggacaactggtaccccagatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggccacatgtgaccaacgtggctgttgctggaatccccagggagctgtaagtgttccctggtgctactattccaagaatcatagctaccatgtagagggcaaccttgtcaacacaaatgcaggattcacagcccggttgaaaaatctgccttcttcaccagtgtttggaagcaatgttgacaatgttcttctcacagcagaatatcagacatctaatcgtttccactttaagttgactgaccaaaccaataacaggtttgaagtgccccacgaacacgtgcagtccttcagtggaaatgctgctgcttctttgacctaccaagttgaaatctccagacagccatttagcatcaaagtgaccagaagaagcaacaatcgtgttttgtttgactcgagcattgggcccctactgtttgctgaccagttcttgcagctctccactcgactgcctagcactaacgtgtatggcctgggagagcatgtgcaccagcagtatcggcatgatatgaattggaagacctggcccatatttaacagagacacaactcccaatggaaacggaactaatttgtatggtgcgcagacattcttcttgtgccttgaagatgctagtggattgtcctttggggtgtttctgatgaacagcaatgccatggaggttgtccttcagcctgcgccagccatcacttaccgcaccattgggggcattctcgacttctatgtgttcttgggaaacactccagagcaagttgttcaagaatatctagagctcattgggcggccagcccttccctcctactgggcgcttggatttcacctcagtcgttacgaatatggaaccttagacaacatgagggaagtcgtggagagaaatcgcgcagcacagctcccttatgatgttcagcatgctgatattgattatatggatgagagaagggacttcacttatgattcagtggattttaaaggcttccctgaatttgtcaacgagttacacaataatggacagaagcttgtcatcattgtggatccagccatctccaacaactcttcctcaagtaaaccctatggcccatatgacaggggttcagatatgaagatatgggtgaatagttcagatggagtgactccactcattggggaggtctggcctggacaaactgtgtttcctgattataccaatcccaactgtgctgtttggtggacaaaggaatttgagctttttcacaatcaagtagagtttgatggaatctggattgatatgaatgaagtctccaactttgttgatggttcggtctcaggatgttccacaaacaacctaaataatcccccattcactcccagaatcctggatgggtacctgttctgcaagactctctgtatggatgcagtgcagcactggggcaagcagtatgacattcacaatctgtatggctactccatggcggtcgccacagcagaagctgccaagactgtgttccctaataagagaagcttcattctgacccgttctacctttgcgggctctggcaagtttgcagcacattggttaggagacaacactgccacctgggatgacctgagatggtccatccctggcgtgcttgagttcaacctttttggcatcccaatggtgggtcctgacatatgtggctttgctttggacacccctgaggagctctgtaggcggtggatgcagttgggtgcattttatccgttttctagaaatcacaatggccaaggctacaaggaccaggatcctgcctcctttggagctgactccctgctgttgaattcctccaggcactaccttaacatccgctatactctattgccctacctatacaccctcttcttccgtgctcacagccgaggggacacggtggccaggccccttttgcatgagttctacgaggacaacagcacttgggatgtgcaccaacagttcttatgggggcccggcctcctcatcactccagttctggatgaaggtgcagagaaagtgatggcatatgtgcctgatgctgtctggtatgactacgagactgggagccaagtgagatggaggaagcaaaaagtcgagatggaacttcctggagacaaaattggacttcaccttcgaggaggctacatcttccccacacagcagccaaatacaaccactctggccagtcgaaagaaccctcttggtcttatcattgccctagatgagaacaaagaagcaaaaggagaacttttctgggataatggggaaacgaaggatactgtggccaataaagtgtatcttttatgtgagttttctgtcactcaaaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgctgcagttcaagatttatgatcccaacaagaatcggtatgaagttccagtccctctgaacatacccagcatgccatccagcacccctgagggtcaactctatgatgtgctcattaagaagaatccatttgggattgaaattcgccggaagagtacaggcactataatttgggactctcagctccttggctttaccttcagtgacatgtttatccgcatctccacccgccttccctccaagtacctctatggctttggggaaactgagcacaggtcctataggagagacttggagtggcacacttgggggatgttctcccgagaccagcccccagggtacaagaagaattcctatggtgtccacccctactacatggggctggaggaggacggcagtgcccatggagtgctcctgctgaacagcaatgccatggatgtgacgttccagcccctgcctgccttgacataccgcaccacagggggagttctggacttttatgtgttcttggggccgactccagagcttgtcacccagcagtacactgagttgattggccggcctgtgatggtaccttactggtctttggggttccagctgtgtcgctatggctaccagaatgactctgagatcgccagcttgtatgatgagatggtggctgcccagatcccttatgatgtgcagtactcagacatcgactacatggagcggcagctggacttcaccctcagccccaagtttgctgggtttccagctctgatcaatcgcatgaaggctgatgggatgcgggtcatcctcattctggatccagccatttctggcaatgagacacagccttatcctgccttcactcggggcgtggaggatgacgtcttcatcaaatacccaaatgatggagacattgtctggggaaaggtctggcctgattttcctgatgttgttgtgaatgggtctctagactgggacagccaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggacgcctctctgaaccaccctccctacatgccacatttggagtccagggacaggggcctgagcagcaagaccctttgtatggagagtcagcagatcctcccagacggctccctggtgcagcactacaacgtgcacaacctgtatgggtggtcccagaccagacccacatacgaagccgtgcaggaggtgacgggacagcgaggggtcgtcatcacccgctccacatttccctcttctggccgctgggcaggacattggctgggagacaacacggccgcatgggatcagctgaagaagtctatcattggcatgatggagttcagcctctttggcatatcctatacgggagcagatatctgtgggttctttcaagacgctgagtacgagatgtgtgttcgctggatgcagctgggggccttttaccccttctcaagaaaccacaataccattgggaccaggagacaagaccctgtgtcctgggatgctgcttttgtgaatatttccagaaatgtcctgcagaccagatacaccctgttgccatatctgtataccttgatgcaaaaggcccacacggagggcgtcactgttgtgcggcctctgctccatgagtttgtgtcagaccaggtgacatgggacatagacagtcagttcctgctgggcccagccttcctggtcagccctgtcctggagcgcaatgccagaaatgtcactgcatatttccctagagcccgttggtacgattactacacgggtgtggatattaatgcaagaggagagtggaagaccttgccagcccctcttgaccacattaatcttcatgtccgtgggggctacatcctgccctggcaagagcctgcactgaacacccacttaagtcgaaagaaccctcttggtcttattattgccctagatgaaaacaaagaagcaaaaggagaacttttctgggatgatgggcaaacaaaggatactgtggccaagaaagtatatcttttatgtgagttttctgtcactcaaaaccacttggaggtgactatttcacaatcaacctacaaggaccccaataatttagcattcaatgagattaaaattcttgggatggaggaacctagcaatgttacggtgaaacacaatggtgtcccaagtcagacttctcctacagtcacttatgattctaacctgaaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggcatccaattcttctggagtccctttttgctattttgtcaacgacctatactctgtcagtgatgttcagtataactcccatggggccacagctgacatctccttaaagtcttctgttcatgccaatgccttcccttccacacccgtgaacccccttcgcctggatgtcacttaccataagaatgaaatgctacagttcaagatttatgatcccaacaacaatcggtatgaagttccagtccctctgaacatacccagcgtgccatccagcacccctgagggtcaactctatgatgtcctcattaagaagaatccatttgggattgaaattcgccggaagagtacaggcactataatttgggactctcagctccttggcttcaccttcaatgacatgtttatccgcatctccacccgccttccctccaagtacctctatggctttggggagactgagcacacgtcctacaggagagacttggagtggcacacttgggggatgttctcccgagaccagcccccagggtacaagaagaattcctatggtgtccacccctactacatggggctagaggaggatggcagtgcccatggagtgctcctgctgaacagcaatgccatggatgtgacgttccagcccctgcctgccttgacataccgtaccacagggggagttctggacttttatgtgttcttggggccaactccagagcttgtcacccagcagtacactgagttgattggccggcctgtgatggtaccttactggtctttggggttccagctgtgtcgctatggctaccagaacgactctgagatctccagcttgtatgatgagatggtggctgcccagatcccttatgacgtgcagtactcagacatcgactacatggagcggcagctggacttcaccctcagccccaagtttgccgggtttccagctctgatcaatcgcatgaaggctgatgggatgcgggtcatcctcattctggatccagccatttctggcaatgagacacagccctatcctgccttcactcggggcgtggaggatgacgtcttcatcaagtacccaaatgatggagacattgtctggggaaaggtctggcctgattttcctgatgttgttgtgaatgggtctctagactgggacagtcaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggatgcctctctgaaccaccctccctacatgccgtatttggagtccagggacaggggcctgagcagcaagaccctgtgcatggagagtcagcagatcctcccagacggctccccggtgcagcactacaatgtgcacaacctgtacgggtggtcccagaccagacccacatacgaagccgtgcaggaggtgacaggacagcgaggggtcgtcatcacccgctccacatttccctcttctggccgctgggcaggacattggctgggagacaacacagccgcgtgggatcagctgaagaagtctatcattggcatgatggagttcagcctcttcggcatatcctatacgggagcagatatctgtgggttctttcaagatgctgaatatgagatgtgtgttcgctggatgcagctgggggccttttaccccttctcaagaaaccacaacaccattgggaccaggagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtttgtgtcagaccaggtgacatgggacatagacagtcagttcctgctgggcccagccttcctggtcagccctgtcctggagcgtaatgccagaaatgtcactgcatatttccctagagcccgctggtatgattactacacgggtgtggatattaatgcaagaggagagtggaagaccttgccagcccctcttgaccacattaatcttcatgtccgtgggggctacatcctgccctggcaagagcctgcactgaacacccacttaagccgccagaaattcatgggcttcaaaattgccttggatgatgaaggaactgctgggggctggctcttctgggatgatgggcaaagcattgatacctatgggaaaggactctattacttggccagcttttctgccagccagaatacgatgcaaagccatataattttcaacaattacatcactggtacaaatcctttgaaactgggctacattgaaatctggggagtgggcagtgtccccgttaccagtgtcagcatctctgtgagtggcatggtcataacaccctccttcaacaatgaccccacgacacaggtattaagcatcgatgtgactgacagaaacatcagcctacataattttacttcattgacgtggataagcactctgtgaatttttacagcaagattctaactaactatgaatgactttgaaactacttatacttcatactcataaaaattattgtgtgttgctaatttgttcatacccactattggtgaaatatttctgttaattttgttatatgttttttgtgtgaaccctaaaggttaaaccttagccctgtgggataggcagttagggaggtgtggaaaatctatgcattaccttaatgtctctgtgtggttagtatggtagtgactgttcatcatatgacatttactgaagatgaactgggtccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggaaaaaggaagagtcaactcacttgaagaagagggtcttgagaaatccttagcataaagggctactggtgagattgagatctgagcaggcaaagctcaaaagagagtttggaggttaaaaataatttatttttgcagtagtgtgctttgaaatgtgtaaatcttatttctaatgtatacaaccacatttcacataaaaatatgcaatttatatgccagataaaaataaaacaagtgaatttgcaagtga

SEQ ID NO: 151383 - DNA, 790 bp, Homo sapiens
  Payload ID: 9808
  Gene Symbol: MGAM
  Gene Name: maltase-glucoamylase
  ENST ID: ENST00000465654
  CDS Start-End: 236-790
gggttaacactgggaaataaaaacttcccacccacttcttgcaggaggctgtgtggttaaatcctgttacattatacttcagctcttaccatggccttgtcattgggttgaactggagctgtattttagattttgccaacaataacaagcgctgccaagtacttcagctgagatcacccaaataatactctactagcaaaagctttgcgtggcgttctaaccatcagaaactgagatggcaagaaagaagctgaaaaaatttactactttggagattgtgctcagtgttcttctgcttgtgttgtttatcatcagtattgttctaattgtgcttttagccaaagagtcactgaaatcaacagccccagatcctgggacaactggtaccccagatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggccacatgtgaccaacgtggctgttgctggaatccccagggagctgtaagtgttccctggtgctactattccaagaatcatagctaccatgtagagggcaaccttgtcaacacaaatgcaggattcacagcccggttgaaaaatctgccttcttcaccagtgtttggaagcaatgttgacaatgttcttctcacagcagaatatcagacatctaatcgtttccacttt

SEQ ID NO: 151384 - DNA, 6525 bp, Homo sapiens
  Payload ID: 9808
  Gene Symbol: MGAM
  Gene Name: maltase-glucoamylase
  Uniprot ID: O43451
  ENST ID: ENST00000549489
  CDS Start-End: 96-5669
agatctttggttgctttggtggactgtgctcctctgcttttattgctaagccatccttcagacagagagggagcggctgcaagaggtaatgagagatggcaagaaagaagctgaaaaaatttactactttggagattgtgctcagtgttcttctgcttgtgttgtttatcatcagtattgttctaattgtgcttttagccaaagagtcactgaaatcaacagccccagatcctgggacaactggtaccccagatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggccacatgtgaccaacgtggctgttgctggaatccccagggagctgtaagtgttccctggtgctactattccaagaatcatagctaccatgtagagggcaaccttgtcaacacaaatgcaggattcacagcccggttgaaaaatctgccttcttcaccagtgtttggaagcaatgttgacaatgttcttctcacagcagaatatcagacatctaatcgtttccactttaagttgactgaccaaaccaataacaggtttgaagtgccccacgaacacgtgcagtccttcagtggaaatgctgctgcttctttgacctaccaagttgaaatctccagacagccatttagcatcaaagtgaccagaagaagcaacaatcgtgttttgtttgactcgagcattgggcccctactgtttgctgaccagttcttgcagctctccactcgactgcctagcactaacgtgtatggcctgggagagcatgtgcaccagcagtatcggcatgatatgaattggaagacctggcccatatttaacagagacacaactcccaatggaaacggaactaatttgtatggtgcgcagacattcttcttgtgccttgaagatgctagtggattgtcctttggggtgtttctgatgaacagcaatgccatggaggttgtccttcagcctgcgccagccatcacttaccgcaccattgggggcattctcgacttctatgtgttcttgggaaacactccagagcaagttgttcaagaatatctagagctcattgggcggccagcccttccctcctactgggcgcttggatttcacctcagtcgttacgaatatggaaccttagacaacatgagggaagtcgtggagagaaatcgcgcagcacagctcccttatgatgttcagcatgctgatattgattatatggatgagagaagggacttcacttatgattcagtggattttaaaggcttccctgaatttgtcaacgagttacacaataatggacagaagcttgtcatcattgtggatccagccatctccaacaactcttcctcaagtaaaccctatggcccatatgacaggggttcagatatgaagatatgggtgaatagttcagatggagtgactccactcattggggaggtctggcctggacaaactgtgtttcctgattataccaatcccaactgtgctgtttggtggacaaaggaatttgagctttttcacaatcaagtagagtttgatggaatctggattgatatgaatgaagtctccaactttgttgatggttcggtctcaggatgttccacaaacaacctaaataatcccccattcactcccagaatcctggatgggtacctgttctgcaagactctctgtatggatgcagtgcagcactggggcaagcagtatgacattcacaatctgtatggctactccatggcggtcgccacagcagaagctgccaagactgtgttccctaataagagaagcttcattctgacccgttctacctttgcgggctctggcaagtttgcagcacattggttaggagacaacactgccacctgggatgacctgagatggtccatccctggcgtgcttgagttcaacctttttggcatcccaatggtgggtcctgacatatgtggctttgctttggacacccctgaggagctctgtaggcggtggatgcagttgggtgcattttatccgttttctagaaatcacaatggccaaggctacaaggaccaggatcctgcctcctttggagctgactccctgctgttgaattcctccaggcactaccttaacatccgctatactctattgccctacctatacaccctcttcttccgtgctcacagccgaggggacacggtggccaggccccttttgcatgagttctacgaggacaacagcacttgggatgtgcaccaacagttcttatgggggcccggcctcctcatcactccagttctggatgaaggtgcagagaaagtgatggcatatgtgcctgatgctgtctggtatgactacgagactgggagccaagtgagatggaggaagcaaaaagtcgagatggaacttcctggagacaaaattggacttcaccttcgaggaggctacatcttccccacacagcagccaaatacaaccactctggccagtcgaaagaaccctcttggtcttatcattgccctagatgagaacaaagaagcaaaaggagaacttttctgggataatggggaaacgaaggatactgtggccaataaagtgtatcttttatgtgagttttctgtcactcaaaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgctgcagttcaagatttatgatcccaacaagaatcggtatgaagttccagtccctctgaacatacccagcatgccatccagcacccctgagggtcaactctatgatgtgctcattaagaagaatccatttgggattgaaattcgccggaagagtacaggcactataatttgggactctcagctccttggctttaccttcagtgacatgtttatccgcatctccacccgccttccctccaagtacctctatggctttggggaaactgagcacaggtcctataggagagacttggagtggcacacttgggggatgttctcccgagaccagcccccagggtacaagaagaattcctatggtgtccacccctactacatggggctggaggaggacggcagtgcccatggagtgctcctgctgaacagcaatgccatggatgtgacgttccagcccctgcctgccttgacataccgcaccacagggggagttctggacttttatgtgttcttggggccgactccagagcttgtcacccagcagtacactgagttgattggccggcctgtgatggtaccttactggtctttggggttccagctgtgtcgctatggctaccagaatgactctgagatcgccagcttgtatgatgagatggtggctgcccagatcccttatgatgtgcagtactcagacatcgactacatggagcggcagctggacttcaccctcagccccaagtttgctgggtttccagctctgatcaatcgcatgaaggctgatgggatgcgggtcatcctcattctggatccagccatttctggcaatgagacacagccttatcctgccttcactcggggcgtggaggatgacgtcttcatcaaatacccaaatgatggagacattgtctggggaaaggtctggcctgattttcctgatgttgttgtgaatgggtctctagactgggacagccaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggacgcctctctgaaccaccctccctacatgccacatttggagtccagggacaggggcctgagcagcaagaccctttgtatggagagtcagcagatcctcccagacggctccctggtgcagcactacaacgtgcacaacctgtatgggtggtcccagaccagacccacatacgaagccgtgcaggaggtgacgggacagcgaggggtcgtcatcacccgctccacatttccctcttctggccgctgggcaggacattggctgggagacaacacggccgcatgggatcagctgaagaagtctatcattggcatgatggagttcagcctcttcggcatatcctatacgggagcagatatctgtgggttctttcaagatgctgaatatgagatgtgtgttcgctggatgcagctgggggccttttaccccttctcaagaaaccacaacaccattgggaccaggagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtttgtgtcagaccaggtgacatgggacatagacagtcagttcctgctgggcccagccttcctggtcagccctgtcctggagcgtaatgccagaaatgtcactgcatatttccctagagcccgctggtatgattactacacgggtgtggatattaatgcaagaggagagtggaagaccttgccagcccctcttgaccacattaatcttcatgtccgtgggggctacatcctgccctggcaagagcctgcactgaacacccacttaagccgccagaaattcatgggcttcaaaattgccttggatgatgaaggaactgctgggggctggctcttctgggatgatgggcaaagcattgatacctatgggaaaggactctattacttggccagcttttctgccagccagaatacgatgcaaagccatataattttcaacaattacatcactggtacaaatcctttgaaactgggctacattgaaatctggggagtgggcagtgtccccgttaccagtgtcagcatctctgtgagtggcatggtcataacaccctccttcaacaatgaccccacgacacaggtattaagcatcgatgtgactgacagaaacatcagcctacataattttacttcattgacgtggataagcactctgtgaatttttacagcaagattctaactaactatgaatgactttgaaactacttatacttcatactcataaaaattattgtgtgttgctaatttgttcatacccactattggtgaaatatttctgttaattttgttatatgttttttgtgtgaaccctaaaggttaaaccttagccctgtgggataggcagttagggaggtgtggaaaatctatgcattaccttaatgtctctgtgtggttagtatggtagtgactgttcatcatatgacatttactgaagatgaactgggtccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggaaaaaggaagagtcaactcacttgaagaagagggtcttgagaaatccttagcataaagggctactggtgagattgagatctgagcaggcaaagctcaaaagagagtttggaggttaaaaataatttatttttgcagtagtgtgctttgaaatgtgtaaatcttatttctaatgtatacaaccacatttcacataaaaatatgcaatttatatgccagataaaaataaaacaagtgaatttgcaagtga

SEQ ID NO: 151385 - DNA, 6483 bp, Homo sapiens
  Payload ID: 9808
  Gene Symbol: MGAM
  Gene Name: maltase-glucoamylase
  Uniprot ID: O43451
  ENST ID: ENST00000620571
  CDS Start-End: 55-5628
attgctaagccatccttcagacagagagggagcggctgcaagaggtaatgagagatggcaagaaagaagctgaaaaaatttactactttggagattgtgctcagtgttcttctgcttgtgttgtttatcatcagtattgttctaattgtgcttttagccaaagagtcactgaaatcaacagccccagatcctgggacaactggtaccccagatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggccacatgtgaccaacgtggctgttgctggaatccccagggagctgtaagtgttccctggtgctactattccaagaatcatagctaccatgtagagggcaaccttgtcaacacaaatgcaggattcacagcccggttgaaaaatctgccttcttcaccagtgtttggaagcaatgttgacaatgttcttctcacagcagaatatcagacatctaatcgtttccactttaagttgactgaccaaaccaataacaggtttgaagtgccccacgaacacgtgcagtccttcagtggaaatgctgctgcttctttgacctaccaagttgaaatctccagacagccatttagcatcaaagtgaccagaagaagcaacaatcgtgttttgtttgactcgagcattgggcccctactgtttgctgaccagttcttgcagctctccactcgactgcctagcactaacgtgtatggcctgggagagcatgtgcaccagcagtatcggcatgatatgaattggaagacctggcccatatttaacagagacacaactcccaatggaaacggaactaatttgtatggtgcgcagacattcttcttgtgccttgaagatgctagtggattgtcctttggggtgtttctgatgaacagcaatgccatggaggttgtccttcagcctgcgccagccatcacttaccgcaccattgggggcattctcgacttctatgtgttcttgggaaacactccagagcaagttgttcaagaatatctagagctcattgggcggccagcccttccctcctactgggcgcttggatttcacctcagtcgttacgaatatggaaccttagacaacatgagggaagtcgtggagagaaatcgcgcagcacagctcccttatgatgttcagcatgctgatattgattatatggatgagagaagggacttcacttatgattcagtggattttaaaggcttccctgaatttgtcaacgagttacacaataatggacagaagcttgtcatcattgtggatccagccatctccaacaactcttcctcaagtaaaccctatggcccatatgacaggggttcagatatgaagatatgggtgaatagttcagatggagtgactccactcattggggaggtctggcctggacaaactgtgtttcctgattataccaatcccaactgtgctgtttggtggacaaaggaatttgagctttttcacaatcaagtagagtttgatggaatctggattgatatgaatgaagtctccaactttgttgatggttcggtctcaggatgttccacaaacaacctaaataatcccccattcactcccagaatcctggatgggtacctgttctgcaagactctctgtatggatgcagtgcagcactggggcaagcagtatgacattcacaatctgtatggctactccatggcggtcgccacagcagaagctgccaagactgtgttccctaataagagaagcttcattctgacccgttctacctttgcgggctctggcaagtttgcagcacattggttaggagacaacactgccacctgggatgacctgagatggtccatccctggcgtgcttgagttcaacctttttggcatcccaatggtgggtcctgacatatgtggctttgctttggacacccctgaggagctctgtaggcggtggatgcagttgggtgcattttatccgttttctagaaatcacaatggccaaggctacaaggaccaggatcctgcctcctttggagctgactccctgctgttgaattcctccaggcactaccttaacatccgctatactctattgccctacctatacaccctcttcttccgtgctcacagccgaggggacacggtggccaggccccttttgcatgagttctacgaggacaacagcacttgggatgtgcaccaacagttcttatgggggcccggcctcctcatcactccagttctggatgaaggtgcagagaaagtgatggcatatgtgcctgatgctgtctggtatgactacgagactgggagccaagtgagatggaggaagcaaaaagtcgagatggaacttcctggagacaaaattggacttcaccttcgaggaggctacatcttccccacacagcagccaaatacaaccactctggccagtcgaaagaaccctcttggtcttatcattgccctagatgagaacaaagaagcaaaaggagaacttttctgggataatggggaaacgaaggatactgtggccaataaagtgtatcttttatgtgagttttctgtcactcaaaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgctgcagttcaagatttatgatcccaacaagaatcggtatgaagttccagtccctctgaacatacccagcatgccatccagcacccctgagggtcaactctatgatgtgctcattaagaagaatccatttgggattgaaattcgccggaagagtacaggcactataatttgggactctcagctccttggctttaccttcagtgacatgtttatccgcatctccacccgccttccctccaagtacctctatggctttggggaaactgagcacaggtcctataggagagacttggagtggcacacttgggggatgttctcccgagaccagcccccagggtacaagaagaattcctatggtgtccacccctactacatggggctggaggaggacggcagtgcccatggagtgctcctgctgaacagcaatgccatggatgtgacgttccagcccctgcctgccttgacataccgcaccacagggggagttctggacttttatgtgttcttggggccgactccagagcttgtcacccagcagtacactgagttgattggccggcctgtgatggtaccttactggtctttggggttccagctgtgtcgctatggctaccagaatgactctgagatcgccagcttgtatgatgagatggtggctgcccagatcccttatgatgtgcagtactcagacatcgactacatggagcggcagctggacttcaccctcagccccaagtttgctgggtttccagctctgatcaatcgcatgaaggctgatgggatgcgggtcatcctcattctggatccagccatttctggcaatgagacacagccttatcctgccttcactcggggcgtggaggatgacgtcttcatcaaatacccaaatgatggagacattgtctggggaaaggtctggcctgattttcctgatgttgttgtgaatgggtctctagactgggacagccaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggacgcctctctgaaccaccctccctacatgccacatttggagtccagggacaggggcctgagcagcaagaccctttgtatggagagtcagcagatcctcccagacggctccctggtgcagcactacaacgtgcacaacctgtatgggtggtcccagaccagacccacatacgaagccgtgcaggaggtgacgggacagcgaggggtcgtcatcacccgctccacatttccctcttctggccgctgggcaggacattggctgggagacaacacggccgcatgggatcagctgaagaagtctatcattggcatgatggagttcagcctctttggcatatcctatacgggagcagatatctgtgggttctttcaagacgctgagtacgagatgtgtgttcgctggatgcagctgggggccttttaccccttctcaagaaaccacaataccattgggaccaggagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtttgtgtcagaccaggtgacatgggacatagacagtcagttcctgctgggcccagccttcctggtcagccctgtcctggagcgtaatgccagaaatgtcactgcatatttccctagagcccgctggtatgattactacacgggtgtggatattaatgcaagaggagagtggaagaccttgccagcccctcttgaccacattaatcttcatgtccgtgggggctacatcctgccctggcaagagcctgcactgaacacccacttaagccgccagaaattcatgggcttcaaaattgccttggatgatgaaggaactgctgggggctggctcttctgggatgatgggcaaagcattgatacctatgggaaaggactctattacttggccagcttttctgccagccagaatacgatgcaaagccatataattttcaacaattacatcactggtacaaatcctttgaaactgggctacattgaaatctggggagtgggcagtgtccccgttaccagtgtcagcatctctgtgagtggcatggtcataacaccctccttcaacaatgaccccacgacacaggtattaagcatcgatgtgactgacagaaacatcagcctacataattttacttcattgacgtggataagcactctgtgaatttttacagcaagattctaactaactatgaatgactttgaaactacttatacttcatactcataaaaattattgtgtgttgctaatttgttcatacccactattggtgaaatatttctgttaattttgttatatgttttttgtgtgaaccctaaaggttaaaccttagccctgtgggataggcagttagggaggtgtggaaaatctatgcattaccttaatgtctctgtgtggttagtatggtagtgactgttcatcatatgacatttactgaagatgaactgggtccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggaaaaaggaagagtcaactcacttgaagaagagggtcttgagaaatccttagcataaagggctactggtgagattgagatctgagcaggcaaagctcaaaagagagtttggaggttaaaaataatttatttttgcagtagtgtgctttgaaatgtgtaaatcttatttctaatgtatacaaccacatttcacataaaaatatgcaatttatatgccagataaaaataaaacaagtgaatttgcaagtg

SEQ ID NO: 151386 - DNA, 6894 bp, Homo sapiens
  Payload ID: 9808
  Gene Symbol: MGAM
  Gene Name: maltase-glucoamylase
  ENST ID: ENST00000632195
  CDS Start-End: 1-6038
ttttcaggttctacgaggacaacagcacttgggatgtgcaccaacagttcttatgggggcccggcctcctcatcactccagttctggatgaaggtgcagagaaagtgatggcatatgtgcctgatgctgtctggtatgactacgagactgggagccaagtgagatggaggaagcaaaaagtcgagatggaacttcctggagacaaaattggacttcaccttcgaggaggctacatcttccccacacagcagccaaatacaaccactctggccagtcgaaagaaccctcttggtcttatcattgccctagatgagaacaaagaagcaaaaggagaacttttctgggataatggggaaacgaaggatactgtggccaataaagtgtatcttttatgtgagttttctgtcactcaaaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgctgcagttcaagatttatgatcccaacaagaatcggtatgaagttccagtccctctgaacatacccagcatgccatccagcacccctgagggtcaactctatgatgtgctcattaagaagaatccatttgggattgaaattcgccggaagagtacaggcactataatttgggactctcagctccttggctttaccttcagtgacatgtttatccgcatctccacccgccttccctccaagtacctctatggctttggggaaactgagcacaggtcctataggagagacttggagtggcacacttgggggatgttctcccgagaccagcccccagggtacaagaagaattcctatggtgtccacccctactacatggggctggaggaggacggcagtgcccatggagtgctcctgctgaacagcaatgccatggatgtgacgttccagcccctgcctgccttgacataccgcaccacagggggagttctggacttttatgtgttcttggggccgactccagagcttgtcacccagcagtacactgagttgattggccggcctgtgatggtaccttactggtctttggggttccagctgtgtcgctatggctaccagaatgactctgagatcgccagcttgtatgatgagatggtggctgcccagatcccttatgatgtgcagtactcagacatcgactacatggagcggcagctggacttcaccctcagccccaagtttgctgggtttccagctctgatcaatcgcatgaaggctgatgggatgcgggtcatcctcattctggatccagccatttctggcaatgagacacagccttatcctgccttcactcggggcgtggaggatgacgtcttcatcaaatacccaaatgatggagacattgtctggggaaaggtctggcctgattttcctgatgttgttgtgaatgggtctctagactgggacagccaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggacgcctctctgaaccaccctccctacatgccacatttggagtccagggacaggggcctgagcagcaagaccctttgtatggagagtcagcagatcctcccagacggctccctggtgcagcactacaacgtgcacaacctgtatgggtggtcccagaccagacccacatacgaagccgtgcaggaggtgacgggacagcgaggggtcgtcatcacccgctccacatttccctcttctggccgctgggcaggacattggctgggagacaacacggccgcatgggatcagctgaagaagtctatcattggcatgatggagttcagcctctttggcatatcctatacgggagcagatatctgtgggttctttcaagacgctgagtacgagatgtgtgttcgctggatgcagctgggggccttttaccccttctcaagaaaccacaataccattgggaccaggagacaagaccctgtgtcctgggatgctgcttttgtgaatatttccagaaatgtcctgcagaccagatacaccctgttgccatatctgtataccttgatgcaaaaggcccacacggagggcgtcactgttgtgcggcctctgctccatgagtttgtgtcagaccaggtgacatgggacatagacagtcagttcctgctgggcccagccttcctggtcagccctgtcctggagcgcaatgccagaaatgtcactgcatatttccctagagcccgttggtacgattactacacgggtgtggatattaatgcaagaggagagtggaagaccttgccagcccctcttgaccacattaatcttcatgtccgtgggggctacatcctgccctggcaagagcctgcactgaacacccacttaagtcgaaagaaccctcttggtcttattattgccctagatgaaaacaaagaagcaaaaggagaacttttctgggatgatgggcaaacaaaggatactgtggccaagaaagtatatcttttatgtgagttttctgtcactcaaaaccacttggaggtgactatttcacaatcaacctacaaggaccccaataatttagcattcaatgagattaaaattcttgggatggaggaacctagcaatgttacggtgaaacacaatggtgtcccaagtcagacttctcctacagtcacttatgattctaacctgaaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggcatccaattcttctggagtccctttttgctattttgtcaacgacctatactctgtcagtgatgttcagtataactcccatggggccacagctgacatctccttaaagtcttctgttcatgccaatgccttcccttccacacccgtgaacccccttcgcctggatgtcacttaccataagaatgaaatgctacagttcaagatttatgatcccaacaacaatcggtatgaagttccagtccctctgaacatacccagcgtgccatccagcacccctgagggtcaactctatgatgtcctcattaagaagaatccatttgggattgaaattcgccggaagagtacaggcactataatttgggactctcagctccttggcttcaccttcaatgacatgtttatccgcatctccacccgccttccctccaagtacctctatggctttggggagactgagcacacgtcctacaggagagacttggagtggcacacttgggggatgttctcccgagaccagcccccagggtacaagaagaattcctatggtgtccacccctactacatggggctagaggaggatggcagtgcccatggagtgctcctgctgaacagcaatgccatggatgtgacgttccagcccctgcctgccttgacataccgtaccacagggggagttctggacttttatgtgttcttggggccaactccagagcttgtcacccagcagtacactgagttgattggccggcctgtgatggtaccttactggtctttggggttccagctgtgtcgctatggctaccagaacgactctgagatctccagcttgtatgatgagatggtggctgcccagatcccttatgacgtgcagtactcagacatcgactacatggagcggcagctggacttcaccctcagccccaagtttgccgggtttccagctctgatcaatcgcatgaaggctgatgggatgcgggtcatcctcattctggatccagccatttctggcaatgagacacagccctatcctgccttcactcggggcgtggaggatgacgtcttcatcaagtacccaaatgatggagacattgtctggggaaaggtctggcctgattttcctgatgttgttgtgaatgggtctctagactgggacagtcaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggatgcctctctgaaccaccctccctacatgccgtatttggagtccagggacaggggcctgagcagcaagaccctgtgcatggagagtcagcagatcctcccagacggctccccggtgcagcactacaatgtgcacaacctgtacgggtggtcccagaccagacccacatacgaagccgtgcaggaggtgacaggacagcgaggggtcgtcatcacccgctccacatttccctcttctggccgctgggcaggacattggctgggagacaacacagccgcgtgggatcagctgaagaagtctatcattggcatgatggagttcagcctcttcggcatatcctatacgggagcagatatctgtgggttctttcaagatgctgaatatgagatgtgtgttcgctggatgcagctgggggccttttaccccttctcaagaaaccacaacaccattgggaccaggagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtttgtgtcagaccaggtgacatgggacatagacagtcagttcctgctgggcccagccttcctggtcagccctgtcctggagcgtaatgccagaaatgtcactgcatatttccctagagcccgctggtatgattactacacgggtgtggatattaatgcaagaggagagtggaagaccttgccagcccctcttgaccacattaatcttcatgtccgtgggggctacatcctgccctggcaagagcctgcactgaacacccacttaagccgccagaaattcatgggcttcaaaattgccttggatgatgaaggaactgctgggggctggctcttctgggatgatgggcaaagcattgatacctatgggaaaggactctattacttggccagcttttctgccagccagaatacgatgcaaagccatataattttcaacaattacatcactggtacaaatcctttgaaactgggctacattgaaatctggggagtgggcagtgtccccgttaccagtgtcagcatctctgtgagtggcatggtcataacaccctccttcaacaatgaccccacgacacaggtattaagcatcgatgtgactgacagaaacatcagcctacataattttacttcattgacgtggataagcactctgtgaatttttacagcaagattctaactaactatgaatgactttgaaactacttatacttcatactcataaaaattattgtgtgttgctaatttgttcatacccactattggtgaaatatttctgttaattttgttatatgttttttgtgtgaaccctaaaggttaaaccttagccctgtgggataggcagttagggaggtgtggaaaatctatgcattaccttaatgtctctgtgtggttagtatggtagtgactgttcatcatatgacatttactgaagatgaactgggtccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggaaaaaggaagagtcaactcacttgaagaagagggtcttgagaaatccttagcataaagggctactggtgagattgagatctgagcaggcaaagctcaaaagagagtttggaggttaaaaataatttatttttgcagtagtgtgctttgaaatgtgtaaatcttatttctaatgtatacaaccacatttcacataaaaatatgcaatttatatgccagataaaaataaaacaagtgaatttgcaagtga

SEQ ID NO: 151387 - DNA, 4199 bp, Homo sapiens
  Payload ID: 9808
  Gene Symbol: MGAM
  Gene Name: maltase-glucoamylase
  ENST ID: ENST00000631981
  CDS Start-End: 1-3343
gttctacgaggacaacagcacttgggatgtgcaccaacagttcttatgggggcccggcctcctcatcactccagttctggatgaaggtgcagagaaagtgatggcatatgtgcctgatgctgtctggtatgactacgagactgggagccaagtgagatggaggaagcaaaaagtcgagatggaacttcctggagacaaaattggacttcaccttcgaggaggctacatcttccccacacagcagccaaatacaaccactctggccagtcgaaagaaccctcttggtcttatcattgccctagatgagaacaaagaagcaaaaggagaacttttctgggataatggggaaacgaaggatactgtggccaataaagtgtatcttttatgtgagttttctgtcactcaaaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgctgcagttcaagatttatgatcccaacaagaatcggtatgaagttccagtccctctgaacatacccagcatgccatccagcacccctgagggtcaactctatgatgtgctcattaagaagaatccatttgggattgaaattcgccggaagagtacaggcactataatttgggactctcagctccttggctttaccttcagtgacatgtttatccgcatctccacccgccttccctccaagtacctctatggctttggggaaactgagcacaggtcctataggagagacttggagtggcacacttgggggatgttctcccgagaccagcccccagggtacaagaagaattcctatggtgtccacccctactacatggggctggaggaggacggcagtgcccatggagtgctcctgctgaacagcaatgccatggatgtgacgttccagcccctgcctgccttgacataccgcaccacagggggagttctggacttttatgtgttcttggggccgactccagagcttgtcacccagcagtacactgagttgattggccggcctgtgatggtaccttactggtctttggggttccagctgtgtcgctatggctaccagaatgactctgagatcgccagcttgtatgatgagatggtggctgcccagatcccttatgatgtgcagtactcagacatcgactacatggagcggcagctggacttcaccctcagccccaagtttgctgggtttccagctctgatcaatcgcatgaaggctgatgggatgcgggtcatcctcattctggatccagccatttctggcaatgagacacagccttatcctgccttcactcggggcgtggaggatgacgtcttcatcaaatacccaaatgatggagacattgtctggggaaaggtctggcctgattttcctgatgttgttgtgaatgggtctctagactgggacagccaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggacgcctctctgaaccaccctccctacatgccacatttggagtccagggacaggggcctgagcagcaagaccctttgtatggagagtcagcagatcctcccagacggctccctggtgcagcactacaacgtgcacaacctgtatgggtggtcccagaccagacccacatacgaagccgtgcaggaggtgacgggacagcgaggggtcgtcatcacccgctccacatttccctcttctggccgctgggcaggacattggctgggagacaacacggccgcatgggatcagctgaagaagtctatcattggcatgatggagttcagcctcttcggcatatcctatacgggagcagatatctgtgggttctttcaagatgctgaatatgagatgtgtgttcgctggatgcagctgggggccttttaccccttctcaagaaaccacaacaccattgggaccaggagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtttgtgtcagaccaggtgacatgggacatagacagtcagttcctgctgggcccagccttcctggtcagccctgtcctggagcgtaatgccagaaatgtcactgcatatttccctagagcccgctggtatgattactacacgggtgtggatattaatgcaagaggagagtggaagaccttgccagcccctcttgaccacattaatcttcatgtccgtgggggctacatcctgccctggcaagagcctgcactgaacacccacttaagccgccagaaattcatgggcttcaaaattgccttggatgatgaaggaactgctgggggctggctcttctgggatgatgggcaaagcattgatacctatgggaaaggactctattacttggccagcttttctgccagccagaatacgatgcaaagccatataattttcaacaattacatcactggtacaaatcctttgaaactgggctacattgaaatctggggagtgggcagtgtccccgttaccagtgtcagcatctctgtgagtggcatggtcataacaccctccttcaacaatgaccccacgacacaggtattaagcatcgatgtgactgacagaaacatcagcctacataattttacttcattgacgtggataagcactctgtgaatttttacagcaagattctaactaactatgaatgactttgaaactacttatacttcatactcataaaaattattgtgtgttgctaatttgttcatacccactattggtgaaatatttctgttaattttgttatatgttttttgtgtgaaccctaaaggttaaaccttagccctgtgggataggcagttagggaggtgtggaaaatctatgcattaccttaatgtctctgtgtggttagtatggtagtgactgttcatcatatgacatttactgaagatgaactgggtccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggaaaaaggaagagtcaactcacttgaagaagagggtcttgagaaatccttagcataaagggctactggtgagattgagatctgagcaggcaaagctcaaaagagagtttggaggttaaaaataatttatttttgcagtagtgtgctttgaaatgtgtaaatcttatttctaatgtatacaaccacatttcacataaaaatatgcaatttatatgccagataaaaataaaacaagtgaatttgcaagtga

SEQ ID NO: 151388 - DNA, 7867 bp, Homo sapiens
  Payload ID: 9809
  Gene Symbol: MGAM2
  Gene Name: maltase-glucoamylase 2 (putative)
  Uniprot ID: Q2M2H8
  ENST ID: ENST00000477922
  CDS Start-End: 55-7602
tccctatgaattgctgagggagagatacagcatagaaaaaaacaaggtgatgcgatggcgaggaagctcagtgtattggaagtccttctgatcatcttctgcttaattgtggtgaccatagatatcctcttgctgcttcttgtgttggaggaaacttcagatacttcatttactccagagtgcccagagattccccagtcggaaaggatagactgcacacctgaccaggaggtgaccgaggatatctgcagatggcaatataagtgctgctggtcgcctgtggcagatgccaatgtccctaggtgcttcttcccctggaactggggctatgaagccagcaatggccatacaaatacaagcacaggatttactgcccagttgaaaaggttgccatcaccatctctgtttggaaatgatgtcgccaccacccttttcacagctgaatatcagacatccaatcggtttcattttaagatcactgactttaataacatacgctatgaagtttcccatgaaaatattaacctggttgatgggattgctgatgcctccaatttgagctattacgtggaggttactgataaacctttcagcatcaaaataatgaggacaagcaacagaagagtcttgttggacacgagcatcgggcccctccagtttgcccagcagtacctgcaactgtctttccgactgcccagtgccaatgtgtatgggctgggagagcatgtgcaccagcagtaccgccacaatatgacctggaagacttggcccatcttcacccgggacgctacccccaccgagggcatgattaatctgtatggagctcatacattcttcttgtgccttgaagatgccaggggctcctcttttggagtatttctgatgaacagtaatgccatggaggttacccttcagccagctcctgcgatcacttatcgcacgattggaggcattcttgacttttacgtattcctaggaaacactccagaacaagtggttcaggaatacttggagcttgttggacggccattcttccctccctattggagtcttgggttccagcttagtcgcagggactatggtggcatcaataaattgaaagaagttgtaagccgaaatcgtttagctgagataccatatgatgtccagtactctgacatagactacatggatggaaagaaggatttcactgttgatgaagtcgcttactctggtctcccagattttgtcaaggagttacatgacaatggacagaaatatcttattattatgaatcctggcatctccaaaaactctaactacgagccctataataatggaagcctaaagagagtgtggatcttggggagcaatggctttgctgttggggagggatatccgggaccgacagtctttcccgattataccaatccagtatgcactgagtggtggacagatcaggtcgctaaatttcatgatcatctggagtttgatggagtgtggattgaaatgaatgaagtatctagcttactccaagcttctaataaccagtgtgaatccaacaacttgaactttcctccttttcttcctagagttctggatcacttactttttgcaagaactctctgcatggacacggagtttcatgggggccttcattatgacatccacagcttgtatggccactccatggcaagaaccacaaacttagccctggagaccatcttcatgaataataggagcttcatcttatcccgttctacttttgctggatctggcaaatttgctgctcattggctgggggacaatgcggccacatgggatgacctccgatggtctatccccactatccttgagttcaacctgtttggcatccccatggtaggtgccaacatctgtggttataacaacaatgtcacagaggagctctgcagaaggtggatgcagcttggagcattttatccactaccaaggaatcacaatgggcctgggttcagggaccaggatcccgctgcctttggtgttgattccctgctgctgaaatcctccagacattatctgaacatccgctacaccttgctgccctatctctatacccttttctaccatgctcacacccggggagagacggtagcaaggccccttgtacatgagttctaccaggactcagccacgtgggatgtgcatgagcagttcttatggggacctggactcctcatcacgcctgttttatatgaaggtgtggacgaagtgaaagcatacatacctgatgccacctggtatgactatgagacaggagtggccatctcatggaggaaacagttggtgaatatgcttctcccaggtgacaagataggacttcatctgcgagggggctacatatttcccactcagaagccaaacacaaccacagaagccagccggaggaattccctgggactcatcatcgccttggactataagagagaagcaaagggggagctgtactgggatgacggtgtatctaaagatgctgtgactgaaaagaagtatattctatatgatttctctgttacctctaaccatctacaagcaaagattataaataataattatatggacactgacaacctcatgttcacagatatcacaatcttgggaatggacaaacagccagctaattttatcgtcctactgaataatgttgccacctccagtccaagcgttgtctacaatgcttccacaaaggtggtaaccatcactgatctccaaggactggtactgggacaagaattctctattaggtggaatcttcctgtcagtgacctggagaagttcaactgctaccctgatgatccaacagcctctgaggagagttgtaggcagcgggggtgtctttgggaggacacatctactcctggagtgcccacctgttactatgacaccatccctaattatgttgctagtgatattcagtacctgaacaccagcatcactgcagacctttccctcccgatggcccctgagtcagctgctgctgccgcctctgattctctctctgcaaagatcagcttcctccacctgaaagtgatctatcacacagcaaccatgctgcaggtcaagatctatgaccccactaataaaaggtatgaggttccagtaccactgaacacccctccccaaccagttggtgaccctgaaaaccgtctgtatgatgtcaggattcagaacaatccttttggaatccagattcaacgcaaaaactccagcactgtgatttgggattctcaactccctggcttcatcttcaatgacatgtttctctccatttctacgcgtctgccgtcccagtacatctatggctttggggaaactgagcacacgactttcagaagaaacatgaactggaacacatggggaatgtttgctcatgatgagccacctgcgtacaagaagaattcctatggtgtccacccttactacatggcactggaggaggatggtagtgcccatggagtgctcctgctaaatagcaatgccatggatgtgacattacagcccactcctgctctgacataccgcaccacaggagggattttggacttctacattgttttggggccaacccctgaacttgtaactcagcaatacacagagttgattggtcggccagcaatgattccatactgggccttgggattccatctgagtcgctatggataccagaatgatgctgaaatctccagtttgtatgatgcaatggtggcagcccagattccctatgacgtccagcatgtagacatcgattacatgaaccggaagctggatttcaccctcagtgccaactttcaaaacctcagtcttctgattgagcaaatgaagaaaaatggcatgagatttattctcattttggacccagccatttctggcaatgagacacagtatctcccattcattagaggacaggaaaataacgtgttcatcaaatggcctgacaccaatgacattgtctggggaaaggtttggccagatctgcctaatgtaattgtagatggatcccttgaccatgaaactcaggttaagctttacagggcctacgttgcctttcctgacttctttcgtaatagcacagctgcgtggtggaagaaagagatagaagagctctatgcaaaccctcgagagccagagaagagcttgaagtttgatggattgtggattgatatgaatgagccatcaaattttgtggatggatctgtcaggggctgcagcaatgaaatgctaaataacccaccctatatgccatatttggaatctagggacaagggcctgagcagcaagactctgtgcatggagagtcagcagatcctgccggacagctcccccgtggagcactacaacgtgcacaacctgtacgggtggtcccagaccagacccacatacgaagctgtgcaggaggtgacaggacagcgaggggtcatcatcacccgctccacatttccctcttctggacgctggggaggacaccggttgggaaacaacacagctgcatgggaccagctggggaaatctatcattggcatgatggagttcagtctctttggaataccttatacaggagcagatatctgtgggttctttggagatgctgaatatgagatgtgtgttcgctggatgcaactgggggcattttatccattttccagaaaccacaacaacatcgggacaaggagacaagatcctgtggcctggaattcaacctttgagatgttgtccagaaaagtcctagagaccagatataccctgcttccttatctctatactctgatgcataaagctcacgttgagggcagcacagttgtccggccccttctccatgagtttacggatgacaggacaacatgggatatagaccgtcagttcatgttgggccctgctatcttaatcagccctgtgttggaaactagcacatttgagatctctgcttattttccgagagcccgttggtatgactatagcacgggaactagcagcacatcaacaggtcagaggaaaatcctgaaggctccccttgaccacatcaaccttcatgtcagaggaggctacatcctgccctggcaagagcctgctatgaacactcactccagtcgacaaaattttatgggattgattgttgctttggatgacaatgggacagctgaaggccaggtgttctgggatgatggacaaagcattgatacctatgaaaatggaaattattttttggcaaactttatagcagctcagaacatcctgcaaatccagaccatacacaataagtatttgagtgactcgaatccactaaaagttgggtatattagaatctggggtgtgaatacctatgtgacacaagtcagtttcacctatgacaaccggcaatttatggagacaaatttcaagagtgaaccttataatcagatactaactattcaattgactgacaagactatcaacctggaaaagttaactgaggttacttggattgatggtggtcctgtacttcctactccaactaagacaagtaccatcccaatgagttctcatccttctccatctactaccaatgccaccagttctgagacaatcaccagttctgccagtgcaaatactaccactggcactactgatactgttcctatcacaaccacatctttcccaagtactactagtgttacaactaatactactgttcctgatacaacttctcctttccctacaagtactactaatgctagcactaatgctactgttcctatcacaaccacacctttcccaacaagtactattggtgttacaactaatgctactgttcccaatacaactgcccctttcccaacaaatgctagtactgctagcactaatgctactgttcctatcacaaccacatgttttgcaacaagtactattggtgttacaactaatgctactgttcccgatacaactgcccctttcccaacaaatactactactgctagcactaatgctactattcctatcacaaccacaccttttgcaacaagtactattagtgttacaactagtactactgttcctgatacaactgctcctttccctacaagtactactagtgctagcactaatgctacccctgttcctatcacaaccacactttttgcaacaagtactattggtgttacaactggtactactgttcctgatacaactgctcctttccctacaagtactactagtactagcactagtgctactgttcctattacaaccacaccttcccctacaaatactgctgatgctaacactagtaatactgttcctaataccactatgccttctcctacaagtagtactactgtgagtactattgctaccgttcccatttcagtgactccttctctgacaagtactgctgatgccaccattagtactactgtacttattgccactacttcttctctaacaggtactactgatgttagcactagtactactattaataatataagtactcctgttcaaacaaatactactaatgctagcactagtactaatgttgctaatataactgctacctctcatacaagtactgatgatactgttcctaataatactgttccagttacagctattccttctcttgcaaatactggtgttgacactactagcaacagtttttccattatgaccacttctttctctgaaagtactaatgctatgaacactactgttattatggcaactacttctcctacaagtactgatgttgctagcacaaataatgatgcttctatgacaaattttcttttagctacaatgtctgctggtaatataactagtaatagtatttccataacaactacttcttttggtaatagtgttccttttgtgactactccttctccaagtactgatgctactactacaagtaataatactaatcctggcatgactacttattaccagacttctcctaccattcctacccatactcttacttctattcctagctctattacttctattttgagcatgtttccaacaagtaatacattcactactgataaaattactaattttactacccctacaaatgcaaacaccattattttcaacactcttgatacaaaaagtaccatggtaatagatgctacggtcactactaccagcaccaaagataataccatgagtccagatacaacagttacttccatagacaaattcaccacacacatcacacagttcgctactccccattctgctactactacaacactggccttaagccacacctcattagctcctacaaatctttctaatctaggcaccatggatattactgatgcagataactccagcagtgttacaggtaacacgacacacatttctgtttcaaatctcacaacagcctcagtcacaataacagccactggtctagattcacaaactccccatatggtaataaattctgtggctacttatttacctattactgcaactagtgctaccacagatactacaaatattacaaaatatgctttaaatactaccactcctgatagtacagtacatacctctgctactgcacctacttatattgcaaatgccataaatgctactcaagttccatgattactactcaaggcaggatagttacctcagataacgcctacaaacaactattacagatatagaaaatcagttacgagacactctatctatcttatgctacttaagttttcacggatattagtactctagccataaaagacacagctactccaaacactctcgtcattgcagacatgtttaggaaggtttacaaaccttataggtttcaccaaagaagctgtgggtacttattttgcaaccatagtatgtgctcttattcttttaa

SEQ ID NO: 151389 - DNA, 1591 bp, Homo sapiens
  Payload ID: 9809
  Gene Symbol: MGAM2
  Gene Name: maltase-glucoamylase 2 (putative)
  Uniprot ID: Q2M2H8
  ENST ID: ENST00000550469
  CDS Start-End: 60-1508
agtgctccctatgaattgctgagggagagatacagcatagaaaaaaacaaggtgatgcgatggcgaggaagctcagtgtattggaagtccttctgatcatcttctgcttaattgtggtgaccatagatatcctcttgctgcttcttgtgttggaggaaacttcagatacttcatttactccagagtgcccagagattccccagtcggaaaggatagactgcacacctgaccaggaggtgaccgaggatatctgcagatggcaatataagtgctgctggtcgcctgtggcagatgccaatgtccctaggtgcttcttcccctggaactggggctatgaagccagcaatggccatacaaatacaagcacaggatttactgcccagttgaaaaggttgccatcaccatctctgtttggaaatgatgtcgccaccacccttttcacagctgaatatcagacatccaatcggtttcattttaagatcactgactttaataacatacgctatgaagtttcccatgaaaatattaacctggttgatgggattgctgatgcctccaatttgagctattacgtggaggttactgataaacctttcagcatcaaaataatgaggacaagcaacagaagagtcttgttggacacgagcatcgggcccctccagtttgcccagcagtacctgcaactgtctttccgactgcccagtgccaatgtgtatgggctgggagagcatgtgcaccagcagtaccgccacaatatgacctggaagacttggcccatcttcacccgggacgctacccccaccgagggcatgattaatctgtatggagctcatacattcttcttgtgccttgaagatgccaggggctcctcttttggagtatttctgatgaacagtaatgccatggaggttacccttcagccagctcctgcgatcacttatcgcacgattggaggcattcttgacttttacgtattcctaggaaacactccagaacaagtggttcaggaatacttggagcttgttggacggccattcttccctccctattggagtcttgggttccagcttagtcgcagggactatggtggcatcaataaattgaaagaagttgtaagccgaaatcgtttagctgagataccatatgatgtccagtactctgacatagactacatggatggaaagaaggatttcactgttgatgaagtcgcttactctggtctcccagattttgtcaaggagttacatgacaatggacagaaatatcttattattatgaatcctggcatctccaaaaactctaactacgagccctataataatggaagcctaaagagagtgtggatcttggggagcaatggctttgctgttggggagggatatccgggaccgacagtctttcccgattataccaatccagtatgcactgagtggtggacagatcaggtcgctaaatttcatgatcatctggagtttgatggagtgtggattgtaagttattattcctgactcaaatttcctttggaaacagataacgccaaattttcagatgagttttgaccttgatgtcaaataaatgtcaataaaaaata

SEQ ID NO: 151390 - DNA, 1591 bp, Homo sapiens; identical to SEQ ID NO: 151389
  Payload ID: 9809
  Gene Symbol: MGAM2
  Gene Name: maltase-glucoamylase 2 (putative)
  Uniprot ID: Q2M2H8
  ENST ID: ENST00000622623
  CDS Start-End: 60-1508

SEQ ID NO: 151391 - DNA, 7867 bp, Homo sapiens; identical to SEQ ID NO: 151388
  Payload ID: 9809
  Gene Symbol: MGAM2
  Gene Name: maltase-glucoamylase 2 (putative)
  Uniprot ID: Q2M2H8
  ENST ID: ENST00000632823
  CDS Start-End: 55-7602

SEQ ID NO: 151392 - DNA, 1761 bp, Homo sapiens
  Payload ID: 9810
  Gene Symbol: MALRD1
  Gene Name: MAM and LDL receptor class A domain containing 1
  ENST ID: ENST00000377265
  CDS Start-End: 1-1522
agaatgcccaagaggaaggtcagctctgctgaaggggccgccacaggaaaagcctaacaggaggtcagcgctgttgtcagtgggagagatctctgagctttgtccggaaatcactgattttttgtgccgggacaagaagtgcattgcatcccaccttctttgtgactataagccagactgctctgataggtctgatgaagctcactgtgcacattatacaagcacaacaggaagctgcaattttgaaacaagttcaggaaactggaccacagcctgcagtcttactcaagactctgaggatgacttggactgggccattggcagcagaattcctgccaaagcattaattccagactctgatcacacgccaggtagtggtcagcacttcctgtacgtcaactcatctggctccaaggaaggatccgttgccagaattactacttccaaatccttcccagcaagccttggaatgtgtactgttcggttctggttctacatgattgatcccaggagtatgggaatattaaaggtgtataccattgaagaatcggggctaaacatcctggtgtggtcagtgattggaaataaaagaacgggatggacatatggctctgtgcctctctccagtaacagtccgtttaaggtggcatttgaagctgatttggatggaaatgaggacatctttattgctcttgatgacatctcttttaccccagagtgtgtgactggaggtcctgtcccagtgcagccatcaccctgtgaagctgatcagttttcttgtatctacacactccaatgtgtccctctctcagggaaatgtgatggacatgaagactgcatagatggatctgatgaaatggattgtcctctcagccccacccctccactctgtagtaacatggagttcccgtgctctacagacgagtgtataccttccctcctgctatgcgatggagtgcccgactgccactttaatgaagatgagctcatctgctccaacaaaagctgttctaatggagctctggtgtgtgcctcctccaacagctgtatcccagcccaccagcgctgtgatggttttgccgactgcatggatttccagcttgatgagtccagctgctccgaatgtccattaaattactgcagaaatggtgggacttgtgtagtggagaaaaatggtcctatgtgtcgatgtagacaaggctggaaaggaaatcgatgccatatcaagtttaatcctcctgctacagacttcacatacgctcagaataatacatggactctcctgggtattggattagcattcctgatgactcacatcacagttgcagtcttgtgttttcttgcaaacagaaaggtaccaataaggaaaaccgagggaagtggtaactgtgcctttgtcaatccagtttacgggaactggagcaacccagagaaaacagagagttctgtctattccttctcaaacccattatatggcacaacatcaggaagcctggagaccctgtcacatcatctcaaatagcagcatcgagaccaagtctgatccaacatgtgtagtttctagaaaattgaagtctccacaatctgatagaaactcatcttctacaatggtaaaaagagaaaggattgtaaatgccagtgtaattataacatttatgaatgaattttcttgcagaatatagagaatgtttatatggaatcagaatcagtaccttatcttcactgaacatctgaatattttaataaaatttctatttaatc

SEQ ID NO: 151393 - DNA, 4461 bp, Homo sapiens
  Payload ID: 9810
  Gene Symbol: MALRD1
  Gene Name: MAM and LDL receptor class A domain containing 1
  ENST ID: ENST00000377266
  CDS Start-End: 1-4461
cctcgggatcatagtctcaacgcatctcaagggcattttatgttcattctgaagaaaagcagcagcttgtggcaagttgctaagcttcagagcccaactttcagccagacaggacctggatgcatactttccttctggttctataactatggcctgtcagtgggagcagctgagctgcagctacatatggaaaattctcatgactcaacagtgatttggagagtattatacaatcagggcaaacaatggttggaggcaaccattcagctagggcgcctttcgcagcccttccatttgtcactagataaagtcagtctgggcatttatgatggggtctcagctattgatgacatccgatttgaaaattgtactctccctcttcctgctgagagctgtgaagggctggatcatttctggtgtcgccacaccagggcttgcatagaaaagcttcggttatgtgatctggtggatgactgtggtgatcgtactgatgaagtcaactgtgcacctgagctgcagtgtaactttgaaactggaatctgtaactgggaacaagatgcaaaagatgactttgattggaccaggagccagggtccaactccaacacttaacacagggccaatgaaagataacactctgggcacagctaaaggacactatctctacatagaatcttcagagccacaggcttttcaagacagtgctgccttactcagcccaatccttaatgccactgatacaaaaggctgcaccttccgcttctattaccacatgtttggaaagcgcatttataggttggcaatctaccaacgaatctggagtgactcaaggggacagctgctgtggcagatatttgggaatcaaggcaacagatggattaggaaacacctcaacatttccagcaggcagccctttcagatattggtggaggcttcagtgggagatggcttcactggagatattgcgattgatgatctgtcatttatggactgcaccctctaccctggtaatttgccagcagacctcccaactccaccagaaacgtcagttcctgtaacattacctccacacaactgcacagacaatgaatttatctgcaggtctgatggtcactgcattgaaaaaatgcagaaatgtgattttaaatatgactgccctgacaaatcagatgaagcatcctgtgttatggaagtttgcagctttgagaaaagaagcctgtgtaaatggtatcaaccaatcccagtacatttgcttcaagattcaaacacattcaggtgggggcttgggaacgggatcagcattcatcatggggaagaaaaccacaggccatcagtggatcatacacaaaataccactgatggctggtacctgtatgctgacagttctaatgggaaatttggtgacacggctgacattctcactcctatcatttcactcacgggaccaaaatgtaccttggtgttctggacacatatgaatggggccaccgttggttctctccaggtgctcatcaagaaagataacgttacttctaaattgtgggctcaaactggacagcaaggtgcacagtggaagagagcagaagtgtttttaggcattcgttcacatacacagattgtcttcagagccaaacgtggtatcagttacataggagatgtagcagtggatgatatttccttccaagattgctcccctttgcttagcccagagagaaagtgtactgatcatgaattcatgtgtgctaataagcactgcattgccaaagacaagctgtgtgattttgtgaatgattgtgctgataattcagatgagactactttcatttgccgtacctccagtgggcgctgtgatttcgaatttgatctttgttcctggaagcaggagaaagatgaggactttgactggaacctgaaagctagcagcatccctgcagcaggcacagagccagcagcagatcacactttgggaaattcatctggtcattacatctttataaagagtttgtttcctcagcagcccatgagagctgccagaatttcaagtccagttataagtaagagaagcaaaaactgcaagattatttttcattatcacatgtatggaaatggcattggggcactcaccttaatgcaggtgtcagtcacaaaccaaacgaaggttctacttaacctcactgtagaacaaggcaatttctggcggagagaagaactgtcactgtttggtgatgaagacttccaactcaaatttgaaggtagagttgggaaaggtcagcgtggagacattgcacttgatgacattgtgcttacagaaaattgtctatcactccatgattccgtgcaagaagaactggcagtgcctcttccaacaggtttctgcccacttggctatagggaatgtcataatggaaaatgctataggctggaacaaagctgtaacttcgtagataactgtggagataatactgatgaaaatgagtgtggtagctcctgtacttttgaaaaaggctggtgtggctggcaaaactcccaggctgacaactttgattgggttttaggggttggctctcatcaaagcttaagacctcccaaagaccacacacttggaaatgaaaatgctatcttgttgatgcgacggcataaatatcccatcagatcagttaatctgcatactgtgaagcacgtgctaaaagcacagacagttggaaattgttctgtcagcaagctagaggcgaggctattagattttctttctgttccaaatgaaaatacttttggcagctcagatcatacgaattggcacttcatgtatctggaagctactgcagtgggccttcggggtgacaaagcacacttcaggagtaccatgtggcgagaatccagtgcagcctgcaccatgagcttctggtatttcgtatctgcaaaggccacaggatccattcagattctcatcaagcgggggcggaggagaaggcgggctcccaatccggttctatccggttctcccaccatcccccgccaggggtctcagcagctcggagggtggaggggcggcagcgccaggcaccgcgcacgcgcctttccggagccagaatgcccaagaggaaggtcagctctgctgaaggggccgccacaggaaaagcctaacaggaggtcagcgctgttgtcagtgggagagatctctgagctttgtccggaaatcactgattttttgtgccgggacaagaagtgcattgcatcccaccttctttgtgactataagccagactgctctgataggtctgatgaagctcactgtgcacattatacaagcacaacaggaagctgcaattttgaaacaagttcaggaaactggaccacagcctgcagtcttactcaagactctgaggatgacttggactgggccattggcagcagaattcctgccaaagcattaattccagactctgatcacacgccaggtagtggtcagcacttcctgtacgtcaactcatctggctccaaggaaggatccgttgccagaattactacttccaaatccttcccagcaagccttggaatgtgtactgttcggttctggttctacatgattgatcccaggagtatgggaatattaaaggtgtataccattgaagaatcggggctaaacatcctggtgtggtcagtgattggaaataaaagaacgggatggacatatggctctgtgcctctctccagtaacagtccgtttaaggtggcatttgaagctgatttggatggaaatgaggacatctttattgctcttgatgacatctcttttaccccagagtgtgtgactggaggtcctgtcccagtgcagccatcaccctgtgaagctgatcagttttcttgtatctacacactccaatgtgtccctctctcagggaaatgtgatggacatgaagactgcatagatggatctgatgaaatggattgtcctctcagccccacccctccactctgtagtaacatggagttcccgtgctctacagacgagtgtataccttccctcctgctatgcgatggagtgcccgactgccactttaatgaagatgagctcatctgctccaacaaaagctgttctaatggagctctggtgtgtgcctcctccaacagctgtatcccagcccaccagcgctgtgatggttttgccgactgcatggatttccagcttgatgagtccagctgctccgatacatggactctcctgggtattggattagcattcctgatgactcacatcacagttgcagtcttgtgttttcttgcaaacagaaaggtaccaataaggaaaaccgagggaagtggtaactgtgcctttgtcaatccagtttacgggaactggagcaacccagagaaaacagagagttctgtctattccttctcaaacccattatatggcacaacatcaggaagcctggagaccctgtcacatcatctcaaatag

SEQ ID NO: 151394 - DNA, 407 bp, Homo sapiens
  Payload ID: 9810
  Gene Symbol: MALRD1
  Gene Name: MAM and LDL receptor class A domain containing 1
  ENST ID: ENST00000418367
  CDS Start-End: 1-201
aatacattcatgaaaataagtgtgctggctagacaacatgtctctcaaaagtttctaacaaacaataacctgaaaatgtactatgagttctgtctattccttctcaaacccattatatggcacaacatcaggaagcctggagaccctgtcacatcatctcaaatagcagcatcgagaccaagtctgatccaacatgtgtagtttctagaaaattgaagtctccacaatctgatagaaactcatcttctacaatggtaaaaagagaaaggattgtaaatgccagtgtaattataacatttatgaatgaattttcttgcagaatatagagaatgtttatatggaatcagaatcagtaccttatcttcactgaacatctgaatattttaataaaatttctatttaatcaa

SEQ ID NO: 151395 - DNA, 774 bp, Homo sapiens
  Payload ID: 9810
  Gene Symbol: MALRD1
  Gene Name: MAM and LDL receptor class A domain containing 1
  ENST ID: ENST00000441070
  CDS Start-End: 1-774
ctcaaatttgaaggtagagttgggaaaggtcagcgtggagacattgcacttgatgacattgtgcttacagaaaattgtctatcactccatgattccgtgcaagaagaactggcagtgcctcttccaacaggtttctgcccacttggctatagggaatgtcataatggaaaatgctataggctggaacaaagctgtaacttcgtagataactgtggagataatactgatgaaaatgagtgtggtagctcctgtacttttgaaaaaggctggtgtggctggcaaaactcccaggctgacaactttgattgggttttaggggttggctctcatcaaagcttaagacctcccaaagaccacacacttggaaatgaaaatgggcacttcatgtatctggaagctactgcagtgggccttcggggtgacaaagcacacttcaggagtaccatgtggcgagaatccagtgcagcctgcaccatgagcttctggtatttcgtatctgcaaaggccacaggatccattcagattctcatcaagacagagaaaggactatcaaaagtatggcaagaaagtaagcagaaccctggtaatcattggcaaaaggctgacatcctgctaggaaagttaaggaattttgaagtcatatttcaaggtatcagaacaagggacctgggaggaggagctgcaattgatgatattgaatttaaaaactgcacaactgtgggagagatctctgagctttgtccggaaatcactgattttttgtgccgggacaag

SEQ ID NO: 151396 - DNA, 6880 bp, Homo sapiens
  Payload ID: 9810
  Gene Symbol: MALRD1
  Gene Name: MAM and LDL receptor class A domain containing 1
  Uniprot ID: Q5VYJ5
  ENST ID: ENST00000454679
  CDS Start-End: 169-6639
gcaaattaactgcctggggagtaatttgttagagttgcagatagttaccaatagtatccagttataagaagcaaatctgggaaaggaagaatagagaaataaaagaatgtttccaatgatggacttacttattacaactgcttgatctctaatagacaataccaagtaatgctcttcttcctggacagaatgttggcattccccatgaatgaaactttttgttgcctttggattgcctgtgttttcaattctacactggctcagcaagggacagaaagctttcagtgtgacaatggagtctccttgcctcctgacagcatttgtgacttcacagatcagtgtggggatagcagtgatgaacggcactgtttgaattatgaaagatgtgattttgaggatggtctctgtcatatgactcaagatcagagtctgcaacctagttggacaaagagaagtgggatgattggtctatcacctccattttatgatcacaatggtgatgtgtctgctcacttcctctcactggtttccagagtggattctatttcctcaagtttaagaagcagagttttccttccaacaaatgatcaacatgactgccagattacattttattacttctcctgccaagtgagtggcaaattaatggttgggcttcaaactgcatgtggaggtcctattcagcatttatggcaaaacacagctgcactcccaaatcagtgggagagaaatgtcatcaaaatccagagttcacagagatttcaggttgtttttgaaggtcaaatggcttcaacgtatgaacaggatgaagtcattgctattgatgatatatctttcagttcaggctgcttgcctgccaatgatggaattttactgtgtcaagaagcattgaatgctgagcgggagctatgccatccagatacagatctctgcagatttgatgctacagatgaagagttgagattgtgtcaggcctgtgggtttgaatttgacatgtgtgagtggacgtcagaagcatctgctggccaaatttcctggatgcgcacaaaagcgagagagatccctgcattcgaatccacacctcagcaggatcaaggaggtgatgatgaaggttattatgtatgggtaggcgctaagcatggtttcactcttaaccatttagacagcagggcttacctaaatagctctgtgtgtcattgcctgggcaagagctgtcatcttcaattctattatgcaatggaaagcagtgtcctgagagtaagactgtataataataaggaagaagaaatattttggacatacaacatatcaactcacagccaatgggtgaaagcagatgtgttaataccagaagatctgaagacatttaagattatttttgaagggactcttttgagccagagaagttttattgcccttgatcacctctgggtctatgcctgtggacagacccaatccagaaagctttgctctgcagacgaattcccttgcactagtggccagtgcatcgccaaagaatctgtctgtgactctcggcaggactgctccgatgagagtgatgaagacccagcaacttgctcaaagcatctcacctgtgactttgagtcgggtttctgcggttgggagccatttctcacagaagattcacactggaagctgatgaaaggattgaataatggagagcaccactttcctgcagctgatcacacagcaaacataaatcatggatcgtttatttatttggaggcacagcgctcccccggggtggccaagcttggaagtcctgttcttacaaaattgctcactgcctctaccccatgtcaggtgcagttttggtatcatttgtctcaacattcaaatctctcagtttttacaagaacgtctctagatggaaacttgcaaaagcagggcaaaataatcagattctccgaatctcagtggagccacgcaaaaattgatctcattgcagaagcgggagaatctactctaccttttcagttaattttggaagctactgttttgtcgtcaaatgctaccgttgctctagatgacatcagtgtgtcccaggaatgtgaaatttcctataaatcactaccaaggaccagtacacaaagcaagttttccaagtgtgactttgaagcaaacagctgtgattggtttgaagcaattagtggtgaccattttgactggatacggagctctcagagtgaactttctgctgattttgagcaccaggctccacctcgggatcatagtctcaacgcatctcaagggcattttatgttcattctgaagaaaagcagcagcttgtggcaagttgctaagcttcagagcccaactttcagccagacaggacctggatgcatactttccttctggttctataactatggcctgtcagtgggagcagctgagctgcagctacatatggaaaattctcatgactcaacagtgatttggagagtattatacaatcagggcaaacaatggttggaggcaaccattcagctagggcgcctttcgcagcccttccatttgtcactagataaagtcagtctgggcatttatgatggggtctcagctattgatgacatccgatttgaaaattgtactctccctcttcctgctgagagctgtgaagggctggatcatttctggtgtcgccacaccagggcttgcatagaaaagcttcggttatgtgatctggtggatgactgtggtgatcgtactgatgaagtcaactgtgcacctgagctgcagtgtaactttgaaactggaatctgtaactgggaacaagatgcaaaagatgactttgattggaccaggagccagggtccaactccaacacttaacacagggccaatgaaagataacactctgggcacagctaaaggacactatctctacatagaatcttcagagccacaggcttttcaagacagtgctgccttactcagcccaatccttaatgccactgatacaaaaggctgcaccttccgcttctattaccacatgtttggaaagcgcatttataggttggcaatctaccaacgaatctggagtgactcaaggggacagctgctgtggcagatatttgggaatcaaggcaacagatggattaggaaacacctcaacatttccagcaggcagccctttcagatattggtggaggcttcagtgggagatggcttcactggagatattgcgattgatgatctgtcatttatggactgcaccctctaccctggtaatttgccagcagacctcccaactccaccagaaacgtcagttcctgtaacattacctccacacaactgcacagacaatgaatttatctgcaggtctgatggtcactgcattgaaaaaatgcagaaatgtgattttaaatatgactgccctgacaaatcagatgaagcatcctgtgttatggaagtttgcagctttgagaaaagaagcctgtgtaaatggtatcaaccaatcccagtacatttgcttcaagattcaaacacattcaggtgggggcttgggaacgggatcagcattcatcatggggaagaaaaccacaggccatcagtggatcatacacaaaataccactgatggctggtacctgtatgctgacagttctaatgggaaatttggtgacacggctgacattctcactcctatcatttcactcacgggaccaaaatgtaccttggtgttctggacacatatgaatggggccaccgttggttctctccaggtgctcatcaagaaagataacgttacttctaaattgtgggctcaaactggacagcaaggtgcacagtggaagagagcagaagtgtttttaggcattcgttcacatacacagattgtcttcagagccaaacgtggtatcagttacataggagatgtagcagtggatgatatttccttccaagattgctcccctttgcttagcccagagagaaagtgtactgatcatgaattcatgtgtgctaataagcactgcattgccaaagacaagctgtgtgattttgtgaatgattgtgctgataattcagatgagactactttcatttgccgtacctccagtgggcgctgtgatttcgaatttgatctttgttcctggaagcaggagaaagatgaggactttgactggaacctgaaagctagcagcatccctgcagcaggcacagagccagcagcagatcacactttgggaaattcatctggtcattacatctttataaagagtttgtttcctcagcagcccatgagagctgccagaatttcaagtccagttataagtaagagaagcaaaaactgcaagattatttttcattatcacatgtatggaaatggcattggggcactcaccttaatgcaggtgtcagtcacaaaccaaacgaaggttctacttaacctcactgtagaacaaggcaatttctggcggagagaagaactgtcactgtttggtgatgaagacttccaactcaaatttgaaggtagagttgggaaaggtcagcgtggagacattgcacttgatgacattgtgcttacagaaaattgtctatcactccatgattccgtgcaagaagaactggcagtgcctcttccaacaggtttctgcccacttggctatagggaatgtcataatggaaaatgctataggctggaacaaagctgtaacttcgtagataactgtggagataatactgatgaaaatgagtgtggtagctcctgtacttttgaaaaaggctggtgtggctggcaaaactcccaggctgacaactttgattgggttttaggggttggctctcatcaaagcttaagacctcccaaagaccacacacttggaaatgaaaatgggcacttcatgtatctggaagctactgcagtgggccttcggggtgacaaagcacacttcaggagtaccatgtggcgagaatccagtgcagcctgcaccatgagcttctggtatttcgtatctgcaaaggccacaggatccattcagattctcatcaagacagagaaaggactatcaaaagtatggcaagaaagtaagcagaaccctggtaatcattggcaaaaggctgacatcctgctaggaaagttaaggaattttgaagtcatatttcaaggtatcagaacaagggacctgggaggaggagctgcaattgatgatattgaatttaaaaactgcacaactgtgggagagatctctgagctttgtccggaaatcactgattttttgtgccgggacaagaagtgcattgcatcccaccttctttgtgactataagccagactgctctgataggtctgatgaagctcactgtgcacattatacaagcacaacaggaagctgcaattttgaaacaagttcaggaaactggaccacagcctgcagtcttactcaagactctgaggatgacttggactgggccattggcagcagaattcctgccaaagcattaattccagactctgatcacacgccaggtagtggtcagcacttcctgtacgtcaactcatctggctccaaggaaggatccgttgccagaattactacttccaaatccttcccagcaagccttggaatgtgtactgttcggttctggttctacatgattgatcccaggagtatgggaatattaaaggtgtataccattgaagaatcggggctaaacatcctggtgtggtcagtgattggaaataaaagaacgggatggacatatggctctgtgcctctctccagtaacagtccgtttaaggtggcatttgaagctgatttggatggaaatgaggacatctttattgctcttgatgacatctcttttaccccagagtgtgtgactggaggtcctgtcccagtgcagccatcaccctgtgaagctgatcagttttcttgtatctacacactccaatgtgtccctctctcagggaaatgtgatggacatgaagactgcatagatggatctgatgaaatggattgtcctctcagccccacccctccactctgtagtaacatggagttcccgtgctctacagacgagtgtataccttccctcctgctatgcgatggagtgcccgactgccactttaatgaagatgagctcatctgctccaacaaaagctgttctaatggagctctggtgtgtgcctcctccaacagctgtatcccagcccaccagcgctgtgatggttttgccgactgcatggatttccagcttgatgagtccagctgctccgaatgtccattaaattactgcagaaatggtgggacttgtgtagtggagaaaaatggtcctatgtgtcgatgtagacaaggctggaaaggaaatcgatgccatatcaagtttaatcctcctgctacagacttcacatacgctcagaataatacatggactctcctgggtattggattagcattcctgatgactcacatcacagttgcagtcttgtgttttcttgcaaacagaaaggtaccaataaggaaaaccgagggaagtggtaactgtgcctttgtcaatccagtttacgggaactggagcaacccagagaaaacagagagttctgtctattccttctcaaacccattatatggcacaacatcaggaagcctggagaccctgtcacatcatctcaaatagcagcatcgagaccaagtctgatccaacatgtgtagtttctagaaaattgaagtctccacaatctgatagaaactcatcttctacaatggtaaaaagagaaaggattgtaaatgccagtgtaattataacatttatgaatgaattttcttgcagaatatagagaatgtttatatggaatcagaatcagtaccttatcttcactgaacatctgaatattttaataaaatttctatttaatcaa

SEQ ID NO: 151397 - DNA, 3616 bp, Homo sapiens
  Payload ID: 9811
  Gene Symbol: MAMDC2
  Gene Name: MAM domain containing 2
  Uniprot ID: Q7Z304
  ENST ID: ENST00000377182
  CDS Start-End: 618-2678
aaattttcctccaggctgtccttggagaattccaccctctttcattctggggagaagaagttaaaattagggccagccctgcgggactgacatgccagatgcagggaagctgtccccagaaataagcgagttcccaccgcggctgggcggggcgggagcctcgggtcccaacccagcggagggactcctggaaggcctgccccttccaagtgtctgcaagggctctggtcccaagctttaaaatcctgagcgaaggcactgcgggccgacctctcctctcccagccagtcgtggctggcctttcaaagtgtgcagttgtctcctccctgtccagccccatcgtcgcccaggaccagctgggccgcggtctgacctgaggctgctgctcagcgccggggcgctggcgctctccattcgagcaccttccagcataccgctcggctccgggagccgctctgcaaagttgggcagctcagagcgcaagctttgcctctcgacttctccctccttgggtccccggcgcccccgcctcccacgatccctttcactaggagcagccagtcccagcgggctggcaacttgcaccccttcctagtcatcctccctgaaacgcgaccatgctgttaaggggcgtcctcctggcgttgcaagccctgcagctcgccggtgccctcgacctgcccgctgggtcctgtgcctttgaagagagcacttgcggctttgactccgtgttggcctctctgccgtggattttaaatgaggaaggccattacatttatgtggatacctcctttggcaagcagggggagaaagctgtgctgctaagtcctgacttacaggctgaggaatggagctgcctccgtttggtctaccagataaccacatcttcggagtctctgtcagatcccagccagctgaacctctacatgagatttgaagatgaaagctttgatcgcttgctttggtcagctaaggaaccttcagacagctggctcatagccagcttggatttgcaaaacagttccaagaaattcaagattttaatagaaggtgtactaggacagggaaacacagccagcatcgcactatttgaaatcaagatgacaaccggctactgtattgaatgtgactttgaagaaaatcatctctgtggctttgtgaaccgctggaatcccaatgtgaactggtttgttggaggaggaagtattcggaatgtccactccattctcccacaggatcacaccttcaagagtgaactgggccactacatgtacgtggactcagtttatgtgaagcacttccaggaggtggcacagctcatctccccgttgaccacggcccccatggctggctgcctgtcattttattaccagatccagcaggggaatgacaatgtcttttccctttacactcgggatgtggctggcctttacgaggaaatctggaaagcagacaggccagggaatgctgcctggaaccttgcggaggtcgagttcagtgctccttaccccatggaggttatttttgaagttgctttcaatggtcccaagggaggttatgttgccctggatgatatttcattctctcctgttcactgccagaatcagacagaacttctgttcagtgccgtggaagccagctgcaattttgagcaagatctctgcaacttttaccaagataaagaaggtccaggttggacccgagtgaaagtaaaaccaaacatgtatcgggctggagaccacactacaggcttagggtattacctgctagccaacacaaagttcacatctcagcctggctacattggaaggctctatgggccctccctaccaggaaacttgcagtattgtctgcgttttcattatgccatctatggatttttaaaaatgagtgacaccctagcagtttacatctttgaagagaaccatgtggttcaagagaagatctggtctgtgttggagtccccaaggggtgtttggatgcaagctgaaatcacctttaagaagcccatgcctaccaaggtggttttcatgagcctatgcaaaagtttctgggactgtgggcttgtagccctggatgacattacaatacaattgggaagctgctcatcttcagagaaacttccacctccacctggagagtgtactttcgagcaagatgaatgtacatttactcaggagaaaagaaaccggagcagctggcacaggaggaggggagaaactcccacttcctacacaggaccaaagggagatcacactactggggtaggctactacatgtacattgaggcctcccatatggtgtatggacaaaaagcacgcctcttgtccaggcctctgcgaggagtctctggaaaacactgcttgacctttttctaccacatgtatggagggggcactggcctgctgagtgtttatctgaaaaaggaagaagacagtgaagagtccctcttatggaggagaagaggtgaacagagcatttcctggctacgagcactgattgaatacagctgtgagaggcaacaccagataatttttgaagccattcgaggagtatcaataagaagtgatattgccattgatgatgttaaatttcaggcaggaccctgtggagaaatggaagatacaactcaacaatcatcaggatattctgaggacttaaatgaaattgagtattaagaaatgatctgcattggatttactagacgaaaaccatacctctcttcaatcaaaatgaaaacaaagcaaatgaatactggacagtcttaacaattttataagttataaaatgactttagagcaccctccttcattacttttgcaaaaacatactgactcagggctctttttttctttttgcatatgacaactgttactagaaatacaggctactggttttgcatagatcattcatcttaattttggtaccagttaaaaatacaaatgtactatattgtagtcattttaaagtacacaaagggcacaatcaaaatgagatgcactcatttaaatctgcattcagtgaatgtattgggagaaaaataggtcttgcaggtttccttttgaattttaagtatcataaatatttttaaagtaaataatacggggtgtcagtaatatctgcagaatgaatgcagtctttcatgctaatgagttagtctggaaaaataaagtcttattttctatgttttattcatagaaatggagtattaatttttaatattttcaccatatgtgataacaaaggatctttcatgaatgtccaagggtaagtcagtattaattaatgctgtattacaaggcaatgctaccttctttattccccctttgaactacctttgaagtcactatgagcacatggatagaaatttaacttttttttgtaaagcaagcttaaaatgtttatgtatacatacccagcaacttttataaatgtgttaaacaattttactgatttttataataaatattttggtaagattttgaataatatgaattcaggcagatatactaaactgcttttatttacttgtttagaaaattgtatatatatgtttgtgtatcctaacagctgctatgaaattataaaattacctaataaaaataatttgaaaatc

SEQ ID NO: 151398 - DNA, 2265 bp, Homo sapiens
  Payload ID: 9811
  Gene Symbol: MAMDC2
  Gene Name: MAM domain containing 2
  ENST ID: ENST00000617216
  CDS Start-End: 618-2265
aaattttcctccaggctgtccttggagaattccaccctctttcattctggggagaagaagttaaaattagggccagccctgcgggactgacatgccagatgcagggaagctgtccccagaaataagcgagttcccaccgcggctgggcggggcgggagcctcgggtcccaacccagcggagggactcctggaaggcctgccccttccaagtgtctgcaagggctctggtcccaagctttaaaatcctgagcgaaggcactgcgggccgacctctcctctcccagccagtcgtggctggcctttcaaagtgtgcagttgtctcctccctgtccagccccatcgtcgcccaggaccagctgggccgcggtctgacctgaggctgctgctcagcgccggggcgctggcgctctccattcgagcaccttccagcataccgctcggctccgggagccgctctgcaaagttgggcagctcagagcgcaagctttgcctctcgacttctccctccttgggtccccggcgcccccgcctcccacgatccctttcactaggagcagccagtcccagcgggctggcaacttgcaccccttcctagtcatcctccctgaaacgcgaccatgctgttaaggggcgtcctcctggcgttgcaagccctgcagctcgccggtgccctcgacctgcccgctgggtcctgtgcctttgaagagagcacttgcggctttgactccgtgttggcctctctgccgtggattttaaatgaggaaggccattacatttatgtggatacctcctttggcaagcagggggagaaagctgtgctgctaagtcctgacttacaggctgaggaatggagctgcctccgtttggtctaccagataaccacatcttcggagtctctgtcagatcccagccagctgaacctctacatgagatttgaagatgaaagctttgatcgcttgctttggtcagctaaggaaccttcagacagctggctcatagccagcttggatttgcaaaacagttccaagaaattcaagattttaatagaaggtgtactaggacagggaaacacagccagcatcgcactatttgaaatcaagatgacaaccggctactgtattgaatgtgactttgaagaaaatcatctctgtggctttgtgaaccgctggaatcccaatgtgaactggtttgttggaggaggaagtattcggaatgtccactccattctcccacaggatcacaccttcaagagtgaactgggccactacatgtacgtggactcagtttatgtgaagcacttccaggaggtggcacagctcatctccccgttgaccacggcccccatggctggctgcctgtcattttattaccagatccagcaggggaatgacaatgtcttttccctttacactcgggatgtggctggcctttacgaggaaatctggaaagcagacaggccagggaatgctgcctggaaccttgcggaggtcgagttcagtgctccttaccccatggaggttatttttgaagttgctttcaatggtcccaagggaggttatgttgccctggatgatatttcattctctcctgttcactgccagaatcagacagaacttctgttcagtgccgtggaagccagctgcaattttgagcaagatctctgcaacttttaccaagatgaaggtccaggttggacccgagtgaaagtaaaaccaaacatgtatcgggctggagaccacactacaggcttagggtattacctgctagccaacacaaagttcacatctcagcctggctacattggaaggctctatgggccctccctaccaggaaacttgcagtattgtctgcgttttcattatgccatctatggatttttaaaaatgagtgacaccctagcagtttacatctttgaagagaaccatgtggttcaagagaagatctggtctgtgttggagtccccaaggggtgtttggatgcaagctgaaatcacctttaagaagcccatgcctaccaaggtggttttcatgagcctatgcaaaagtttctgggactgtgggcttgtagccctggatgacattacaatacaattgggaagctgctcatcttcagagaaacttccacctccacctggagagtgtactttcgagcaagatgaatgtacatttactcaggagaaaagaaaccggagcagctggcacaggaggaggggagaaactcccacttcctacacaggaccaaagggagatcacactactggggtag

SEQ ID NO: 151399 - DNA, 3658 bp, Homo sapiens
  Payload ID: 9812
  Gene Symbol: MAMDC4
  Gene Name: MAM domain containing 4
  Uniprot ID: Q6UXC1
  ENST ID: ENST00000317446
  CDS Start-End: 51-3464
ggaacttcccaggcaccctgtgtggccgcactgctccctctggcccaaccatgcctctgtccagccacctgctgcccgccttggtcctgttcctggcagggtcctcaggctgggcctgggtccccaaccactgcaggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggctggtacatggccgttggaacccaccgagggaaagaggcatccaccgcagccctgcgctcgccaaccctgcgagaggcagcctcctcttgcaagctgaggctctggtaccacgcggcctctggagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgcgctggtggtcctgagcgcccctcctggccacgccgtgaccacagccggaacagtgcacagggctccttcctggtctccgtggccgagcctggcacccctgctatactctccagccccgaattccaagcctcaggcacctccaactgctcgctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggtggtgtttgaggcagtggccgcaggcgtggcacactcctacgtggctctggatgatctgctcctccaggacgggccctgccctcagccaggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagccc

SEQ ID NO: 151400 - DNA, 3895 bp, Homo sapiens
  Payload ID: 9812
  Gene Symbol: MAMDC4
  Gene Name: MAM domain containing 4
  Uniprot ID: Q6UXC1
  ENST ID: ENST00000445819
  CDS Start-End: 51-3701
ggaacttcccaggcaccctgtgtggccgcactgctccctctggcccaaccatgcctctgtccagccacctgctgcccgccttggtcctgttcctggcagggtcctcaggctgggcctgggtccccaaccactgcaggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggctggtacatggccgttggaacccaccgagggaaagaggcatccaccgcagccctgcgctcgccaaccctgcgagaggcagcctcctcttgcaagctgaggctctggtaccacgcggcctctggagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgcgctggtggtcctgagcgcccctcctggccacgccgtgaccacagccggaacagtgcacagggctccttcctggtctccgtggccgagcctggcacccctgctatactctccagccccgaattccaagcctcaggcacctccaactgctcgctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgaggcttcctggcactagttgtggtggacaacggctcccgggagctggcatggcaggccctgagcagcagtgcaggcatctggaaggtggacaaggtccttctaggggcccgccgccggcccttccggctggagtttgtcggtttggtggacttggatggccctgaccagcagggagctggggtggacaacgtgaccctgagggactgtagccccacagtgaccaccgagagagacagagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggtggtgtttgaggcagtggccgcaggcgtggcacactcctacgtggctctggatgatctgctcctccaggacgggccctgccctcagccaggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagccc

SEQ ID NO: 151401 - DNA, 2603 bp, Homo sapiens
  Payload ID: 9812
  Gene Symbol: MAMDC4
  Gene Name: MAM domain containing 4
  ENST ID: ENST00000479475
  CDS Start-End: 1-711
ctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggtgagtgcagggtggggtgcccctccccctccccctcccccgagggctgcctggacccgctgaggctgccctgccctgcacccgccaggtggtgtttgaggcagtggccgcaggcgtggcacactcctacgtggctctggatgatctgctcctccaggacgggccctgccctcagccaggtgggagccctgccgtggcctcggccctgctctggggtgcctgcctagccctttcccttcgtagtcgtggtgcccagggcttgggccgtggggcagcaccactcacccacccatgtcctgcaggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctgtgagtccggctgggccaatgggtgcctgggcaacgggggcagcaggggtccaggagcagaggtggggaggtggcctccccagcccgcccctggttaggcgtgcaggagccccaggaccccaggcctgacacgccctggccctgctctcagacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccgggtgagccctgggctgcagtggaggcacggaggagggcccaaggggccagcctggctcggggtttgccaggcttaccagtgtgtggtcccaggagctgcgagcatgctgcacccagacaggacaagagagctgccaggcccaggccctgtgccctcctcactctgccctgctcacccctggggccgctgcctgggctgggctgtccctggggtgcagcctctggggcctgccctgcctggctgtggcctctgtgctccctgtgcccacacccagggcaaggtccatcctggaggaaccgccagccgggtcagggcagccactgactgctctcacttggtgagggaaagaatctcgcctggggccatgagccccaccaagtctgcagacagcagctgcctgtctgccaggccccatccttgtggtagcagaaccaataccctctgcctttgaaataggggtgaaccccaggagccagcagaggctgagggaccatgcagccccaggcttcctccttagccccagatgtgggggctgctttggagggctcacatgtccctatggcccacagggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagccc

SEQ ID NO: 151402 - DNA, 478 bp, Homo sapiens
  Payload ID: 9813
  Gene Symbol: MDGA1
  Gene Name: MAM domain containing glycosylphosphatidylinositol anchor 1
  ENST ID: ENST00000418178
  CDS Start-End: 1-478
tgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagcacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggctccctcaacct

SEQ ID NO: 151403 - DNA, 10736 bp, Homo sapiens
  Payload ID: 9813
  Gene Symbol: MDGA1
  Gene Name: MAM domain containing glycosylphosphatidylinositol anchor 1
  Uniprot ID: Q8NFP4
  ENST ID: ENST00000434837
  CDS Start-End: 1180-4047
ggagagcgagagaccgaacgaggagacgcgaggaggagggaggaggaagagagggagggaggcgggaggagcgcggaatgaaaagctcggaggggcgaaaaagcagcacagcaaagcccaagttgctgagcgagcggagcgctcccgcggcccggagccgagcggccgccgcgccccggagcccggcccggccccgcccgctctgggcccccgcaggccaaggccgccgggcgggggcggggacgaccaacttggggcgcggcgtagccccgctctcccgagagctcggagcccgggagggctacggccgcggccagacggcgggagaggagcgcggcgagcggaggcggcgagcggcgcccgcgccgcagccccggcctgggcgagagcgcgaatatttttcaaaagactcaaactttcctcctttccccgttttctggggcccttcttgcctggaattgctctccagattcccgcggggcgccgggctgctattcttcccccgggtttatcggcggctcggctaacttcacggacccggggacccgcggcgctcgtccctcggccgaacccagcccgcgctgctccccggatcaggagggccgggcccggggctgcttcgccgccgcgagtgctttcagcccggccccctggagtcgggccgctgagcccacggcagcggccgcaggactggaaacagcagattgattaactcgagcggagccccggcctccccgactccgctccgctgaggggcggccccagtgcggggaaacgacaagtttgtcagtcgtccgtggcctgttggatcgaagcgccgcctccgccgccgagaggtccccggcgcctagcatcccgcgcggacggccctgggtacccggggcggctcggcggccgggctcctcgggtcggggcgctggctgctgtgccgggcgcgccgaggcacccggggctgggccagcgccccctgcgtccccacgcgggcagcggccccgccggaggagaaacacgggtcgccgccacctccgcctcttcagtctcctggtcttcgtcgccgctctctctctcacctctcagggaaagggggggacataggggcgtcgcggggccccggcgaatgcgccccccgccgcctctcgggctgcgccgcctcgcggggatgaagcaccggccgtgaagatggaggtgacctgccttctacttctggcgctgatccccttccactgccggggacaaggagtctacgctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgacatctatgagcccctctacactcagggggagaccaaggtcctgaagctgaagaacctgcggccccaggactatgccagctacacctgccaggtgtctgtgcgtaacgtgtgcggcatcccagacaaggccatcaccttccggctcaccaacaccacggcaccaccagccctgaagctgtctgtgaacgaaactctggtggtgaaccctggggagaatgtgacggtgcagtgtctgctgacaggcggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagttcccgccggaggtggagcccagttcccaggacgtgcgccaggcgctgggccggcccgtgctcctgcgctgctcgctgctgcgaggcagcccccagcgcatcgcctcggctgtgtggcgtttcaaagggcagctgctgccgccgccgcctgttgttcccgccgccgccgaggcgccggatcacgcggagctgcgcctcgacgccgtaactcgcgacagcagcggcagctacgagtgcagcgtctccaacgatgtgggctcggctgcctgcctcttccaggtctccgccaaagcctacagcccggagttttacttcgacacccccaaccccacccgcagccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagcccatcaactctccgaacctttcagacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggctccctcaacctcctggtgcggtcccggaacaaaggggctctggacacgcacgcctggtctctcagtggcaataagggcaatgtgtggcagcaggcccatgtgcccatcagccccagtgggcccttccagattatttttgagggggttcgaggcccgggctacctgggggatattgccatagatgacgtcacactgaagaagggggagtgtccccggaagcagacggatcccaataaagtggtggtgatgccgggcagtggagccccctgccagtccagcccacagctgtgggggcccatggccatcttcctcttggcgttgcagagatgatgagagctgtgtggccacccccccaaccttgcccccggcacaccaaagtgtccacattgtaccaaagactgacccccgccagctggggtgcccaggggcagggccggcccgccagggagggggcctgcattggctgcaaggatgagcagagaacaaggacagaggccaggcactgaggccctggagacagctgttccacttgcacacacgcacacactcatgctcacacacacagagatatattaaagcacaagtttctatctgacctgccagcaccttctttactgcaaagacaggggacttgcctgaatggcatccgccaacccagggacctcggcgcaacataggccttgtccttgctgcactcgtggtgtgcttctgactttaccctgtcccctaagtcaaggccgaactccagcctggtggctttgccagaagggagccagaagtggggcagacatggagcccctcccttggtcagactctgggactcctgagatgggagaggcagggatcagaggacgaacaggtgggactttgcgagctctgtgactgtcccacgtccaggagacaaggaaggtagggcacctgctgcacacgattctgtccagagtgagcactggatggtggagaccataggtcaccccagattccttgacctatttctgggacaccatatttccctcctcagtgtgcaccctttgaagggacccagcacagggtcttgggcctgggcagtctgaagactgataacttccccactccaccctacaagcagtgggactcctgagaacacggttctctcctagcctcagcccccagctgggtctcagaggagctgggggagcggtggccagcccattttctggggtgaggcttgacttggagaaaggcagaagagacgtcccgcttctgtgatttggtgcccccatatcagacaatgaatttggaagtggagaggggccttcatttcttatctacttggcatgaaagggtgccctggataggagggtgtgtacagggcaaaatgccaaaaagcactgtctagttgaaagttcccttctccacccaggggcagtgaaggaggaggggcttatagagctgggattggtggagggagcaggtgccagtcccctcactctctgggagctgtgaaagggatccctgtccttgggtcctgggttaggcacctgagattgacatgatgggatctagatctttcctccttgacatcacctgagcccccacctagccatccatgggagagagaaggcccagccccttctagaatgactctttaggcatgcgtgcatatgtgtgtatgtgtttgtgcccgtctgtgtctaggtaccaccgtgggtacattgttgggcaggagtgtgtgcaaacacaggtctgtgtgtgcaatctcacatatctgcctgtgagactggattgagacccattcgtttctatgaatgtccgtgtacgtcagcgtgtgtgtccaccttcctgagtgatgtgttcgcttgtagggtgctggctgaatagactctgtccagccctgttctgtagtctcaagctgcctgcgatggcctgaaattccacctttcatcccctatggatgacggagagcttacagatgaccctattgaatgcaagcacctttggtgaggagcatcacagggctccttctggagcatttggtggggacagctgcagagaagaggcctggaactcgggcagcactgcagtgccaggaggcaggcggggaaccgaggcaaaggctgcccatctccccctgccaggcctgtgtgatcattatcaccaacagctggtgggtggccgggccaggatgcagcggggccttctgatgcccaatcagcacggctgccttcctgacccagtcaaggcctctgtctgaaatgagtcgctccaggttctcagcatacacttccatcgcgtctgtcgggtattgttccttaactgtcccatctgtgcagagtccattgccccaactagactgtgagctcctcctctgagccttccaagtcccccctccaccttcgccacctcccgctcgtgcccagcacaagtgagcctggtgtggaaaccactccattgcccggtggaatggattctgtaatcagtggttcctggccttgcctgcagaatagaaccaccagagtcctttaaaaagtattgctgcttggttcccacctcagaggttctgagttaattggactggagcgcagtcggacatcaagaaatgttgaaaagctccttgggttctcctgacagcaggaaccactggcctggcaccacctgggtgcttcctctgtgccctcgctggggtaggcattggagcaccagagatgaatagccccaagtgctccctctttggggttcccaaggcaccctgtgcctgcttccctcagaggaccttccaatccatttgccccgcaaccctggctgctccgacaggggagacttgtctcccttgttcccctcaggatccatagagtggacagtaaaggtgctcagtacatgttggctgagctgaactgcatacatgtggcccccaggttcctggtctttatggacgaagggcacaaggtggaggggggatggggggatgctgctggaggtctcagtgggtgcagacagccctgccttgaggatggcttgacctgggattgacaaaatgtgtctgctgaaatgctgaggtccccacgtgtgaatgggtgaggctgatgtggatgtctgtgtgtgccagcaggtgggtgggggatgtgggtgtcagtgtatgccagtgggcactgtaaatgtctaggcatgtgctggtctctgtgtgtttgtgtgttcctcagcaggaatgagtgtctttgtgtatcacctggtgacttgtcagtgtctgtgtctgtgtgtgcctgtgagccagcatctctgtatcagtgttgctcatgctgtgtctttgtgcgccatggtgtgtcagtgtctgtgtgttgatgggtggcccatgagtgacccccgccaggggagaccaggctggctggatccagcacatctccccagtggcagcctcgccctctgggtcagggtgactgaggcattttgtggccttaaaacggggtgttcagggtcagccctcagggtgctggggcccttccatcccttgtccccttcaggttggtgaaaaggactccgggggccaggtgctgtatagcagcttatggaagtctcagctgggctatcctgcccttgggagcacagacaggctcctagggtgctgagtgaagcctgaagaccaagccccctcctcctggaatgctccttccacccctacctctcagagatgggcctgacacctctttctcattcattctccttttccctgtgctctgggaaagcccctggctcaggctgtcagagtgaggatggacctcaaaagtttgatcccctcgtgcagatgaagaagctgaagcccagagtggggaaggggagtggcccaaggtcacacagctagtttgagtagagccagtcttgggagagccaagtactacagccctgggggtgtcacaccgcttgtcactgcccctgaggtctcctgccaaacaactgcagggagtttggctaacagtcctgtgtccagggtgccggtggggatgttatagatgttgctgggatcctgccctcggctccaaattctggcctctcatcccaggctgcagacccttctgccccatgacaggcctgggtgccacacagaggtggccaccctcccaccacagtgtctgcagctgctgcccttctcccaggcccccagacagaagagaccctgtttcccctcctctcccctgtgacttcacaagagcttgggctaggagtgaaggtcagcatgttctcatgtgctcatcctcttggtttccccaaagaccgggagggtcacggatggggcgtgcagaatccttgtgttttttctcgctgggcagcttgaggggctggggagtattcccagggtctttgctctggagagtccctgcagagccactggctgaggttgggttcagggttcagcggagtcctccatgcttccaaaggccgggaagcacccgcctctctatcgagtcagtgctgtgcgtgtgtgtctgagaatgtgtgtgatgtgtggagtgtgcgtgtgtttgtgtgtgtgtgtgtgtgtgttggggcagaaggaccactctttcctggggatcccttgacccttataactagaagggaccttagggagcatctaagctggtgcccccattgtacaggcgaggtccagagggatggcatctgcccaccccaccccttgccctcttgttgcctgcactcatttcccagggaccctcctaggataggactgccctccttcctggccccctcccgccatcctcccagccacccacataatcaccatctcagcccaactctggtggccctctaggtctccatgcattcttcctgccctagagtagccagctcaccaaggcctttatccccagcccaggagaagggtcagggagggaaggggctgcaccagccctgagacctcaaagacttgggagaaaagccaaaactcctcatgcccaggcccacatgtctgaccaccccagcccaccccgccaccaaggtaaaagcacaacaggagacccccttattaatgggtgaaatgattggggttgtttttttagtcacacagccccatcctcacccctttgccttgctgtctgtctccaccccagcctctgttccccatttgcctctctttcacctccaagcccccaaatgtaacctctagttgcggacgcggttgttctatcaataaagctgcagtgttctagcgctcagcgtcagccgtgtgtgttggcagggcagagtgggccagggtcggggccggggcactggagggctcctctcagctccctgggggcagcctttcttctctttggcacctgtcgacagggatcctgctctgtggcctggacagtgaggacctgcatcctggtctgctcccagtgaacttgtgtgcatttgttcattcagcaaataccaaccaaacactgcctttgtggaagcccctgtttaatgggagagatggacagtaagctaataatgacaccaagacatatataatgatgtgtacagtgagggctgggaagggaaattggtgctatgaaagaaggtatgaagagggttcttatttgggttggggcttcggggaagacttctctaagagacatttaggagagacagaatgattggagttagcctgttgggattgggagaggcttctgagcagagggaacagaatatgcaaaggccaacagggcccaaaaacttagaaggctcaaggaaggggagtaagggcaaaggaggaggactaaagttggtatggtggttgaaatgccattttcccttctcggcacccaaccctaccatccctcctacacgcttggagtcccttccctcttaatctctattctggccctacagaccccaccctgcaccctacttggggctgcctcccttattcaccaccagctagctgcatccttgccctaagatcaagttatgccaacctttccctttaccccagacctctcagaattctagaatttcagagctaggaggtccttaaaggtcacttatttcaaacatctactcatatattgtaggtgagatgggcttgccaaggtcatggggataggcagtgatgagcatttgcaaagtgaccccaaatcaagggtgtggatgtcatgatatggactacatcatatcaggcaaatgacaggaagtgtctttcaggttacttggttacaatgattcaggtaggtcgattgggcagtttcacttccatgttccagatggggaaactgaagctcagattacaagaccaagggctccctctccctaccacctaagttttattggctctcatgttgggtaacttcttgctggcacacctggcctttcttttctaatggaagaggaagggtctaagggactcaccactgctgtaggttggctccctgagcacaggaagagaaatccgctcaagctcactcaagtacaggtgcattattgtgaggacaaacacagtgagggggatgggcactcagaaatccaaacaggagttgcaacagggatggttttcctgaaccagatgggcattttggattcaaggtagctctaggatcatcatctacagaagtttctggtgcttctgtattcttctggtgcttctgtattctacctgtggtagaataaagatggctgcaaatcccatgttatccttcctgtagagaggcagagtctaattcccttcctcttgaatctgggttgctcttagtgccttgtttgtgcaatagaatgtgacatgctgagttgaagatgccttggagcttcagctcaggcctcttggaacgttctctctggaagccctgaactgccacctaggatgtcctctgagttgctctgagaccgtcatgctggaggggctctggctgaccatcccagctgagtccagccttccagccatctccaccaaagcaccagaagatatgggagtgcagctgcctcagaccttccagaccagcctaactgccacctgaattgctcggccaagctctgtccaaattcctgacccatcgtcatgggatataataaaatagttgttttaa

SEQ ID NO: 151404 - DNA, 594 bp, Homo sapiens
  Payload ID: 9813
  Gene Symbol: MDGA1
  Gene Name: MAM domain containing glycosylphosphatidylinositol anchor 1
  ENST ID: ENST00000515437
  CDS Start-End: 207-594
agtctccccgcttgttagctgctgcgattgtctgcgctcccacgggccgacctaaaacaattcttgcgcacacgctgagataaataacggcgacaggtggagcagctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgaca

SEQ ID NO: 151405 - DNA, 3021 bp, Homo sapiens
  Payload ID: 9813
  Gene Symbol: MDGA1
  Gene Name: MAM domain containing glycosylphosphatidylinositol anchor 1
  Uniprot ID: Q8NFP4
  ENST ID: ENST00000505425
  CDS Start-End: 1-2922
atggaggtgacctgccttctacttctggcgctgatccccttccactgccggggacaaggagtctacgctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgacatctatgagcccctctacactcagggggagaccaaggtcctgaagctgaagaacctgcggccccaggactatgccagctacacctgccaggtgtctgtgcgtaacgtgtgcggcatcccagacaaggccatcaccttccggctcaccaacaccacggcaccaccagccctgaagctgtctgtgaacgaaactctggtggtgaaccctggggagaatgtgacggtgcagtgtctgctgacaggcggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagttcccgccggaggtggagcccagttcccaggacgtgcgccaggcgctgggccggcccgtgctcctgcgctgctcgctgctgcgaggcagcccccagcgcatcgcctcggctgtgtggcgtttcaaagggcagctgctgccgccgccgcctgttgttcccgccgccgccgaggcgccggatcacgcggagctgcgcctcgacgccgtaactcgcgacagcagcggcagctacgagtgcagcgtctccaacgatgtgggctcggctgcctgcctcttccaggtctccgccaaagcctacagcccggagttttacttcgacacccccaaccccacccgcagccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagcccatcaactctccgaacctttcagacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggctccctcaacctcctggtgcggtcccggaacaaaggggctctggacacgcacgcctggtctctcagtggcaataagggcaatgtgtggcagcaggcccatgtgcccatcagccccagtgggcccttccagattatttttgagggggttcgaggcccgggctacctgggggatattgccatagatgacgtcacactgaagaagggggagtgtccccggaagcagacggatcccaataaaggtgcaagacgggaaggaggtgggggagctgaatctggagggagctgtgcgtggcgggggttcctgtctgttgagggagggtgtttgggtctgaataggggttcagaatgtctgagtgatgggaatcatgtggctctgactgtgtgaaggtgtgccccacactcactcaggctgtgtacttgtgtaaacaatgagaagcctggcccccaccctcgtgatgagcatactgacctgttcacggtatca

SEQ ID NO: 151406 - DNA, 582 bp, Homo sapiens
  Payload ID: 9813
  Gene Symbol: MDGA1
  Gene Name: MAM domain containing glycosylphosphatidylinositol anchor 1
  ENST ID: ENST00000502298
  CDS Start-End: 1-262
ccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtacatcctgaccgatctccgtgtgccccacagctatgagacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggtggtgaaggttgcagtgagctgagattgtaccattgcactccatcctgggcagcaagagcaaaactccatttcaaaaaaaaaaaa

SEQ ID NO: 151407 - DNA, 542 bp, Homo sapiens
  Payload ID: 9813
  Gene Symbol: MDGA1
  Gene Name: MAM domain containing glycosylphosphatidylinositol anchor 1
  ENST ID: ENST00000508399
  CDS Start-End: 312-542
actgtccctttcctgagttcctggcccgcctggttctgtcctagaggtcctgggaggattctttcctgggctcagtggggtcaggcctctgaggaatggcctggggagatctgggctgacccctcccagatacactcaggagggagccccagacttcttctggccttggcacctcttctctaaacctcctcctccatcctctcctgccagctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatg

SEQ ID NO: 151408 - DNA, 2965 bp, Homo sapiens
  Payload ID: 9814
  Gene Symbol: MDGA2
  Gene Name: MAM domain containing glycosylphosphatidylinositol anchor 2
  Uniprot ID: Q7Z553
  ENST ID: ENST00000357362
  CDS Start-End: 636-2819
tcgagcatctggttattcaagctcctcccacggttcgtattgtgcactcaggcttggcctgtaacattgaagaggagcgctactccgaaagggtctacactatccgggaaggagaaacccttgagttgacttgtctagtcacaggacatccacgtccacagatcaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacagttccacccaatctgactgttccacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtatccccctgcagtggaaccagcattcttggaaatccggcaaggacaggatcgaagtgtcactatgagttgcagagtactgagagcctatccaatacgggtgctgacctatgagtggcgcttgggcaataaattattacggacgggtcaatttgactctcaggaatacacagagtacgctgtgaagagtctttccaatgaaaactatggggtttataactgtagcatcataaatgaagctggagctgggagatgcagctttcttgttacaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgtttatctacgtttgaaagggcaaacaacaatagagaatccactgtggtcttcaagtgggaataaaggacaaagatggaatgaggctcatgttaatatatacccaattacttcatttcagctcatttttgaaggtatccgaggtcctggaatagaaggtgacattgctattgatgatgtatcaattgcagaaggagaatgtgcaaaacaagacctagcaactaagaattccgttgatggtgctgttgggattttggttcatatatggctttttcccattatcgtcctcatctctatcttaagtcctcgaaggtgaccttatcctggcagaggctataaaagattcaccaggcactggcatgaagaaagagtctttgtaaatggacattgaacaaacaaactaccaaagattcctccactgactactgactcaaaaataaaataataaaaacaaattttttt

SEQ ID NO: 151409 - DNA, 5075 bp, Homo sapiens
  Payload ID: 9814
  Gene Symbol: MDGA2
  Gene Name: MAM domain containing glycosylphosphatidylinositol anchor 2
  Uniprot ID: Q7Z553
  ENST ID: ENST00000399232
  CDS Start-End: 366-3236
acttcgcctcgcagctccccttcccatcaccgccccctgctcctccccggcgtctgcgattttcccaggcacccggtgtgagtgcggcgtgcgtgtgagtgtgtgtcagggtattgtgttgtgggagagtgtgtgagtgtgtgtgagtgtgtgtgtgcatgagtgtgtggagtgcggggctcctgcgctccgctcgccgccgccgccggggaaggacagacggacggcgcttcctccttcggcgagcggttcccgggcacctcggcttggcccgggcgcgagtggagcgcgcctggctggccgccggcctcctgaaggtcccgttgcgtaccccctgggctggatatgttcatgttcacgtgaagatggatttactgtacggtctcgtgtggctgctgacagtcctcctggaggggatctctggccaaggagtgtacgctcctcccacggttcgtattgtgcactcaggcttggcctgtaacattgaagaggagcgctactccgaaagggtctacactatccgggaaggagaaacccttgagttgacttgtctagtcacaggacatccacgtccacagatcaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacagttccacccaatctgactgttccacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtatccccctgcagtggaaccagcattcttggaaatccggcaaggacaggatcgaagtgtcactatgagttgcagagtactgagagcctatccaatacgggtgctgacctatgagtggcgcttgggcaataaattattacggacgggtcaatttgactctcaggaatacacagagtacgctgtgaagagtctttccaatgaaaactatggggtttataactgtagcatcataaatgaagctggagctgggagatgcagctttcttgttacaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgtttatctacgtttgaaagggcaaacaacaatagagaatccactgtggtcttcaagtgggaataaaggacaaagatggaatgaggctcatgttaatatatacccaattacttcatttcagctcatttttgaaggtatccgaggtcctggaatagaaggtgacattgctattgatgatgtatcaattgcagaaggagaatgtgcaaaacaagacctagcaactaagaattccgttgatggtgctgttgggattttggttcatatatggctttttcccattatcgtcctcatctctatcttaagtcctcgaaggtgaccttatcctggcagaggctataaaagattcaccaggcactggcatgaagaaagagtctttgtaaatggacattgaacaaacaaactaccaaagattcctccactgactactgactcaaaaataaaataataaaaacaaatttttttaagcactggggataaaaagacatcatggaagtataacttattccagactaaacataaaagataatcttgacctgagtagagaagagaccttcaggtgcttttgtggctaaaaagattacagcgtcatctggttgaactctggaaaaaaaaaaaaaaatgaaaaaaagaaaaaaaaaagagctatagaaatccttgtcaaagcacaaagtcatggctggttttgtttcaaatgaatagtttgcttgttaccatggaaacctaatggcctgccaacaaaaacctcactgtaaacagggtacgtgaagagctggcatttattttccttacgagaaggttttcgtagagaattaaataaatgtaggcccttttacctttggctgttacccttccttgaaaataacccgaactcagaattatttaaagcattcatgtttctccccaccttatccccatcccacctttattattattatttttctcccatggctaagctagataactgtatgctgtctctttttgcatgcactactatccaggatggtaaacctgggcttacatgttacacaggcttatcggagtttgcttgcggccacttgaacacccaaactacgtcatctgttccaatgaagaaaccaaaccaccatcttttataaattgccatggaaaccaagtgccttcaatgaaacaagcctgaataattttcaactcagaagcttgcactgctaagagtggtttgtgtaaaactattttataaacaaactacagagcctaaatgtgcaaattacaggcaagacaacaaagccgcttctgaagaagaaaggaccgaagctgctgcgtaagcccatgcagacaagatatttgttgtttaacctcctagacagccatggcctttcggcttattgtccattagaaaatcacttccattgagaccagacatggagcaacactttttttcttccaggttattaaatgggtcaaccagagcaaaaggttattaagaatacttagtgcagaaggtggtaaaacacaaaagtgatttttttactctaacctccatttgaaatgaaattggccctagctttagagggaacaagaaaatgtttgggattgcagtgcatactaactctacagtggaactgggcctgaaaaatctggctttattctaaactctgagggtaatatgcctctgccctttagtcagactctgtgcaaattgtgaaatattattttattattttaccaagattataaaaacacttttacaaaaaaacaaaaacctgtaaaaataattttgagctacctgacgacaaatcatatctttaaccagccagttttccaatgcattgtaaatttcacttaaacctgttggttatgaaaatttgaagatcattttccttaaattatctcagcttttaacttcatttaaaaagacttttgtctaagaagaatattattattatatgttctttcaacaccccaggattaaaaaaactgattatgcaagcaattggaatataagtattaaattatagcatttgcaaatattaatataaaagcacaacaaaatgtagtggaaaatgacaaagcttgttttttaaaacaattctgtagaaatgtttgtgcaaattcagtaattcaacttaaaatataattttacagctatgttcaataaagcctctttccaggtaaggta

SEQ ID NO: 151410 - DNA, 5110 bp, Homo sapiens
  Payload ID: 9814
  Gene Symbol: MDGA2
  Gene Name: MAM domain containing glycosylphosphatidylinositol anchor 2
  ENST ID: ENST00000426342
  CDS Start-End: 328-2808
gactcgacagctcctcccacggttcgtattgtgcactcaggcttggcctgtaacattgaagaggagcgctactccgaaagggtctacactatccgggaaggagaaacccttgagttgacttgtctagtcacaggacatccacgtccacagatcaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacagttccacccaatctgactgttccacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtatccccctgcagtggaaccagcattcttggaaatccggcaaggacaggatcgaagtgtcactatgagttgcagagtactgagagcctatccaatacgggtgctgacctatgagtggcgcttgggcaataaattattacggacgggtcaatttgactctcaggaatacacagagtacgctgtgaagagtctttccaatgaaaactatggggtttataactgtagcatcataaatgaagctggagctgggagatgcagctttcttgttacaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgtttatctacgtttgaaagggcaaacaacaatagagaatccactgtggtcttcaagtgggaataaaggacaaagatggaatgaggctcatgttaatatatacccaattacttcatttcagctcatttttgaaggtatccgaggtcctggaatagaaggtgacattgctattgatgatgtatcaattgcagaaggagaatgtgcaaaacaagacctagcaactaagaattccgttgatggtgctgttgggattttggttcatatatggctttttcccattatcgtcctcatctctatcttaagtcctcgaaggtgaccttatcctggcagaggctataaaagattcaccaggcactggcatgaagaaagagtctttgtaaatggacattgaacaaacaaactaccaaagattcctccactgactactgactcaaaaataaaataataaaaacaaatttttttaagcactggggataaaaagacatcatggaagtataacttattccagactaaacataaaagataatcttgacctgagtagagaagagaccttcaggtgcttttgtggctaaaaagattacagcgtcatctggttgaactctggaaaaaaaaaaaaaaatgaaaaaaagaaaaaaaaaagagctatagaaatccttgtcaaagcacaaagtcatggctggttttgtttcaaatgaatagtttgcttgttaccatggaaacctaatggcctgccaacaaaaacctcactgtaaacagggtacgtgaagagctggcatttattttccttacgagaaggttttcgtagagaattaaataaatgtaggcccttttacctttggctgttacccttccttgaaaataacccgaactcagaattatttaaagcattcatgtttctccccaccttatccccatcccacctttattattattatttttctcccatggctaagctagataactgtatgctgtctctttttgcatgcactactatccaggatggtaaacctgggcttacatgttacacaggcttatcggagtttgcttgcggccacttgaacacccaaactacgtcatctgttccaatgaagaaaccaaaccaccatcttttataaattgccatggaaaccaagtgccttcaatgaaacaagcctgaataattttcaactcagaagcttgcactgctaagagtggtttgtgtaaaactattttataaacaaactacagagcctaaatgtgcaaattacaggcaagacaacaaagccgcttctgaagaagaaaggaccgaagctgctgcgtaagcccatgcagacaagatatttgttgtttaacctcctagacagccatggcctttcggcttattgtccattagaaaatcacttccattgagaccagacatggagcaacactttttttcttccaggttattaaatgggtcaaccagagcaaaaggttattaagaatacttagtgcagaaggtggtaaaacacaaaagtgatttttttactctaacctccatttgaaatgaaattggccctagctttagagggaacaagaaaatgtttgggattgcagtgcatactaactctacagtggaactgggcctgaaaaatctggctttattctaaactctgagggtaatatgcctctgccctttagtcagactctgtgcaaattgtgaaatattattttattattttaccaagattataaaaacacttttacaaaaaaacaaaaacctgtaaaaataattttgagctacctgacgacaaatcatatctttaaccagccagttttccaatgcattgtaaatttcacttaaacctgttggttatgaaaatttgaagatcattttccttaaattatctcagcttttaacttcatttaaaaagacttttgtctaagaagaatattattattatatgttctttcaacaccccaggattaaaaaaactgattatgcaagcaattggaatataagtattaaattatagcatttgcaaatattaatataaaagcacaacaaaatgtagtggaaaatgacaaagcttgttttttaaaacaattctgtagaaatgtttgtgcaaattcagtaattcaacttaaaatataattttacagctatgttcaataaagcctctttccaggtaaggtatgacaagcagtatgtgtgtttgttgagcaatgttcacttatcactaaaatgaaattagttatacaatttattggttaccatgggataaatcttcagtgctccacataccttaatgtctgcagaaagaaattttaataggaactccctgatgcactcccctatattgtaatacatgcagaaagcagttaaacctttgaaggtaaaatatgaaacatatatgaacctggaatttaatgtctattttcagtcagttcaaaaggggaccagtttgaatatttaggtagtgatggaattgatctgaaccaagtcctttaaattaaacataataaacaaatgagtttcataacttatttgaatgaattagacatcttaaaattttttcagagtttcacagtaacccatatactttatcagaccaaagagattcaagtacacaatatctggggcatttcttttacgtttt

SEQ ID NO: 151411 - DNA, 1918 bp, Homo sapiens
  Payload ID: 9814
  Gene Symbol: MDGA2
  Gene Name: MAM domain containing glycosylphosphatidylinositol anchor 2
  ENST ID: ENST00000482848
  CDS Start-End: 705-1457
gcttgagcctgtaccagaatgataagtggaaattagtcctcaaagtaacctcagctgtttcattattgtgtgcctcgagcatctggttattcaagctcctcccacggttcgtattgtgcactcaggcttggcctgtaacattgaagaggagcgctactccgaaagggtctacactatccgggaaggagaaacccttgagttgacttgtctagtcacaggacatccacgtccacaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacaggtaacactattggagataaaagaaatatattgacttcttccaaaacactacccctggaaagtacccacttaactacagatagatgtggtttctccatagaatggaagctctacaaagtctgagactttgtctgcatcactcattgctataatctcaatagccgaaacaatacatggcacatagaagacaggagcagctcctcaatttgtggtgtccagtgaaaataaaaatgcatgccccttgttcaaaaattaataaactcactatggcaacatcaaagcattaaagcaaatttggggctgttctaagtgtggctacacggatggcaggctcttgaggctagatggcctaggagattttattgtgatagaaggcctacagaagatgatgcctaacctaaagaatgagttactgaagatgattacatattctgtcttcaagccaaaactgacctttgatgttccaatttgcttacaatagagtggaatactagaatgcagtataaagttctataaatctgagattgtatgattcaactgacatcattaaaatgatatttatcccaatactattgaagactaaa

SEQ ID NO: 151412 - DNA, 757 bp, Homo sapiens
  Payload ID: 9814
  Gene Symbol: MDGA2
  Gene Name: MAM domain containing glycosylphosphatidylinositol anchor 2
  ENST ID: ENST00000554762
  CDS Start-End: 1-757
aaagatcttaaaactaaagaatcttcgacctcaggactatgctaattatagctgcattgcttcagtgaggaatgtatgtaatattcctgataagatggtgtcgtttagactgtccaataaaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacagttccacccaatctgactgttccacaggaaaaatcaccattggtcaccagagaaggagacacaatagaactgcaatgtcaagtaactggcaaacctaaaccaatcatcctttggtct

SEQ ID NO: 151413 - DNA, 574 bp, Homo sapiens
  Payload ID: 9814
  Gene Symbol: MDGA2
  Gene Name: MAM domain containing glycosylphosphatidylinositol anchor 2
  ENST ID: ENST00000486952
  CDS Start-End: 149-574
aaaaaaacaaacaaacaaaaaaaatcaccattccttttaatagcttgagcctgtaccagaatgataagtggaaattagtcctcaaagtaacctcagctgtttcattattgtgtgcctcgagcatctggttattcaaggtgaggcttccatgttcaagtatgaatcccttgggatctgccgcaggactcacggtagtgctgcctgcttctcccactctgtggctgactcccctgaggtagcattctgccaggcaaagctgcctttccttcctcctactactgtgacttcagaagctcctcccacggttcgtattgtgcactcaggcttggcctgtaacattgaagaggagcgctactccgaaagggtctacactatccgggaaggagaaacccttgagttgacttgtctagtcacaggacatccacgtccacagatcaggtggaccaaaacagcaggaagtgcctctgacagattccaagactcaagtgtcttcaatgagactttgaggattacaaatattcagcgacaccaaggaggccggtattactgtaaagcagagaatggcttggggtct

SEQ ID NO: 151414 - DNA, 3635 bp, Homo sapiens
  Payload ID: 9814
  Gene Symbol: MDGA2
  Gene Name: MAM domain containing glycosylphosphatidylinositol anchor 2
  ENST ID: ENST00000557238
  CDS Start-End: 802-1503
ggctccagccttggccagcccagaaaggggctcccacagtgcagcggcgggctgaagggctcctcaagcgcggccagagtgagtgccaaagccgaggaggcgccgagagcgaaggagggctgtgagggctgccagctggctgtcacctcacagtgtagcggacaggaagaagaatgttgccaggcagctcctcccacggttcgtattgtgcactcaggcttggcctgtaacattgaagaggagcgctactccgaaagggtctacactatccgggaaggagaaacccttgagttgacttgtctagtcacaggacatccacgtccacagatcaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtatccccctgcagtggaaccagcattcttggaaatccggcaaggacaggatcgaagtgtcactatgagttgcagagtactgagagcctatccaatacgggtgctgacctatgagtggcgcttgggcaataaattattacggacgggtcaatttgactctcaggaatacacagagtacgctgtgaagagtctttccaatgaaaactatggggtttataactgtagcatcataaatgaagctggagctgggagatgcagctttcttgttacaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtggagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggctcttgctatgttgcccaggctggtctcaaggaatcttcccaccttcgcctctcaaaatgctgggattacaggcatgagtcattgtgcccagccagaaagcttttgagaagttaaactactataaacttgaagtcaggagacctgggcaggaacttggctgtagcacttcatcactgtaatacttcagagaaatcacttaaaatgtctgaaccttggtttccttatctgtaaaatgagaataataactcttatttcagaaagctgtagtttaagttaaattaggcaacatacatagtatcttcaaccagatggcagacactcataatcttaggttactttgaatctgaaatagcaataataatagcaataataaaataatagttgacatttatggagtactcatcatgggctaggatactttgtggattatttctcttaattttcacgatcaacatttgtgcttattaaaatcattatcctgtttcatagataacaaaattgaaatacaaaggactttagttaccatgcccatcacctggctaagtagtgaagccataacacaaacatgggaagctggacagagtctgcctgttttattactgtgcaggaacacttgttggaagattttgcaagcctagctaagtatgtgacagttacttagtagtggtgtgagttattagattttctgcaatcaaaaagcataatgagatatttgatttaggaaaataaacataaaaataggtaaaatcattcagaaacagaatctagactgggaatcacttaaagaaccaatgaaaggaaacaaatcgcataattgccaagccattttatttattgtgggattactatattattactaatgtaggattagctcaactctaattcttcctttttgttaataatgtatactctgtttcctctttgttttgaatatgtgtcatgtactttctttctcctcttccaatttacattggatcacatattttaattgatttttaaataaatatttccaagaccaata

SEQ ID NO: 151415 - DNA, 2440 bp, Homo sapiens
  Payload ID: 9815
  Gene Symbol: MASP1
  Gene Name: mannan-binding lectin serine peptidase 1 (C4/C2 activating component of Ra-reactive factor)
  Uniprot ID: P48740
  ENST ID: ENST00000169293
  CDS Start-End: 326-1468
gccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacactattccagaaaataatgaaaaaaaaatgtgggatttattttagcacctctgagtggactgtacttttctcaacggaaaaaaaaaatgcccttggtccttgagacaaaagatttaatatacaaccatgtggcctcaggctgaccagatcaaagtggtttctaatccattctacatgtcaagtttaaatgaaccagactgcctgtgactttatgaatctgaaggtattacctgttgctgctttcttaaccaccatgagtaggtaaagcaaataataactcacagagtgtggatttttgagaatctgaatgttttctcattcacaaaagtatcccttctacccctatctggcgcagggctgaaatgtcatcattagaggttctgtcttctggggcttacaagttctatgtttcttaaaattcgctgattaaaaattttaaaaagataggatcacacctgaaagcagtggtcccagctctgtgctgtgggacatcacaggtcctaaacagtgatagagaaagggctggggagtggcagctggaatctctgcttccgtctgaacatctggacacacatgtcagagaatctttgcattaaatggactgcccgatctatttggtgattaaatggctgtgcggtgaggggagaaccctgggcagtctggagactgaggtgccattctcggctagagacaccacccaaagaagagatgggctggctactaaagacaagtgtcagttgaataaatgtctttaaacct

SEQ ID NO: 151416 - DNA, 4015 bp, Homo sapiens
  Payload ID: 9815
  Gene Symbol: MASP1
  Gene Name: mannan-binding lectin serine peptidase 1 (C4/C2 activating component of Ra-reactive factor)
  Uniprot ID: P48740
  ENST ID: ENST00000296280
  CDS Start-End: 227-2413
agagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccactttctcaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaaca

SEQ ID NO: 151417 - DNA, 5276 bp, Homo sapiens
  Payload ID: 9815
  Gene Symbol: MASP1
  Gene Name: mannan-binding lectin serine peptidase 1 (C4/C2 activating component of Ra-reactive factor)
  Uniprot ID: P48740
  ENST ID: ENST00000337774
  CDS Start-End: 391-2490
acacacagagtgatacaaatacctgcttgagcccctcagttattttctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagtgtgtgggctccccaagttctcccggaagctgatggccaggatcttcaatggacgcccagcccagaaaggcaccactccctggattgccatgctgtcacacctgaatgggcagcccttctgcggaggctcccttctaggctccagctggatcgtgaccgccgcacactgcctccaccagtcactcgatccggaagatccgaccctacgtgattcagacttgctcagcccttctgacttcaaaatcatcctgggcaagcattggaggctccggtcagatgaaaatgaacagcatctcggcgtcaaacacaccactctccacccccagtatgatcccaacacattcgagaatgacgtggctctggtggagctgttggagagcccagtgctgaatgccttcgtgatgcccatctgtctgcctgagggaccccagcaggaaggagccatggtcatcgtcagcggctgggggaagcagttcttgcaaaggttcccagagaccctgatggagattgaaatcccgattgttgaccacagcacctgccagaaggcttatgccccgctgaagaagaaagtgaccagggacatgatctgtgctggggagaaggaagggggaaaggacgcctgtgcgggtgactctggaggccccatggtgaccctgaatagagaaagaggccagtggtacctggtgggcactgtgtcctggggtgatgactgtgggaagaaggaccgctacggagtatactcttacatccaccacaacaaggactggatccagagggtcaccggagtgaggaactgaatttggctcctcagccccagcaccaccagctgtgggcagtcagtagcagaggacgatcctccgatgaaagcagccatttctcctttccttcctcccatcccccctccttcggcctatccattactgggcaatagagcaggtatcttcacccccttttcactctctttaaagagatggagcaagagagtggtcagaacacaggccgaatccaggctctatcacttactagtttgcagtgctgggcaggtgacttcatctcttcgaacttcagtttcttcataagatggaaatgctataccttacctacctcgtaaaagtctgatgaggaaaagattaactaatagatgcatagcacttaacagagtgcatagcatacactgttttcaataaatgcaccttagcagaaggtcgatgtgtctaccaggcagacgaagctctcttacaaacccctgcctgggtcttagcattgatcagtgacacacctctcccctcaaccttgaccatctccatctgcccttaaatgctgtatgcttttttgccaccgtgcaacttgcccaacatcaatcttcaccctcatccctaaaaaagtaaaacagacaaggttctgagtcctgtggtatgtcccctagcaaatgtaactaggaacatgcactagatgacagattgcgggagggcctgagagaagcagggacaggagggagcctggggattgtggtttgggaaggcagacacctggttctagaactagctctgcccttagccccctgtatgaccctatgcaagtcctcctccctcatctcaaagggtcctcaaagctctgacgatctaagatacaatgaagccattttccccctgataagatgaggtaaagccaatgtaaccaaaaggcaaaaattacaatcggttcaaaggaactttgatgcagacaaaatgctgctgctgctgctcctgaaatacccacccctttccactacgggtgggttcccaaggacatgggacaggcaaagtgtgagccaaaggatccttccttattcctaagcagagcatctgctctgggccctggcctccttcccttcttgggaaactgggctgcatgaggtgggccctggtagtttgtaccccaggcccctatactcttccttcctatgtccacagctgaccccaagcagccgttccccgactcctcacccctgagcctcaccctgaactccctcatcttgcaaggccataagtgttttccaagcaaaatgcctctcccatcctctctcaggaagcttctagagactttatgccctccagagctccaagatataagccctccaagggatcagaagctccaagttcctgtcttctgttttatagaaattgatcttccctgggggactttaactcttgacctgtatgcagctgttggagtaattccaggtctcttgaaaaaaaagaggaagataatggagaatgagaacatatatatatatatattaagccccaggctgaatactcagggacagcaattcacagcctgcctctggttctataaacaagtcattctacctctttgtgccctgctgtttattctgtaaggggaaggtggcaatgggacccagctccatcagacacttgtcaagctagcagaaactccattttcaatgccaaagaagaactgtaatgctgttttggaatcatcccaaggcatcccaagacaccatatcttcccatttcaagcactgcctgggcacaccccaacatcccaggctgtggtggctcctgtgggaactacctagatgaagagagtatcatttataccttctaggagctcctattgggagacatgaaacatatgtaattgactaccatgtaatagaacaaaccctgccaagtgctgctttggaaagtcatggaggtaaaagaaagaccattctggtatgaaggttttgggggaggagatatcaatcaagaaggcttcccagaagaggtgactggaccagagccttgtccacaggtaagacggaggaggccttccacatggagggagaacaatagtaaatgtccactcaagatgtcctttattataccagctcctcccacaaaaacacatgtccagtggactctttttctgggatcagaaccaacaccaaaaagagcttttctccttaaagttagaattctaaacaggacttgaaatggcctcaaggtttgtgcacaaatactgacttctggctggacccagcttattctgtttatttctccaattgcaatttcatccttatcctgagaaaatgtctaaataggccatggaacccaggcttccccgtgacctacaagcacttattagctgtgccagctcctgcactgctgctaaggtccaagaaacccagatctctcacagagccatagaagcagagggctggagtatctgtgaggacaacaaccttgtctaacttcgcgacctcattcttgagcatttctactgatgagaaactcactacccccaattgcagctcattcaactttaaaattgctgctttttgaatcactgattgtgaatattaatttaaaaaaataagtaagaaaatgttttaaatgtgctgcctctttaaaaggtctcctctttgtgcaaccaaaacccacctctctagaatacagtttgtataactgaagctataatttcataccatgagtgctgctgttagcaataataatcatgcccggattttattaacaacagaagctgttgctcgtatgaaaaaacaaacattagttctaataaacatctgcattgagtc

SEQ ID NO: 151418 - DNA, 1673 bp, Homo sapiens
  Payload ID: 9815
  Gene Symbol: MASP1
  Gene Name: mannan-binding lectin serine peptidase 1 (C4/C2 activating component of Ra-reactive factor)
  ENST ID: ENST00000392470
  CDS Start-End: 435-1499
gggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgagggtgctgcctgctggcgaatgtgactctcctcctgttcacccacaaggctgatttttccgtgttcctcctctggaaagagcattgctttctctcttccagcactttgtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaa

SEQ ID NO: 151419 - DNA, 3900 bp, Homo sapiens
  Payload ID: 9815
  Gene Symbol: MASP1
  Gene Name: mannan-binding lectin serine peptidase 1 (C4/C2 activating component of Ra-reactive factor)
  Uniprot ID: P48740
  ENST ID: ENST00000392472
  CDS Start-End: 453-2300
tctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccactttctcaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaa

SEQ ID NO: 151420 - DNA, 962 bp, Homo sapiens
  Payload ID: 9815
  Gene Symbol: MASP1
  Gene Name: mannan-binding lectin serine peptidase 1 (C4/C2 activating component of Ra-reactive factor)
  ENST ID: ENST00000392475
  CDS Start-End: 349-962
ttttctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgagacctacattcatgtctttcaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcac

SEQ ID NO: 151421 - DNA, 553 bp, Homo sapiens
  Payload ID: 9815
  Gene Symbol: MASP1
  Gene Name: mannan-binding lectin serine peptidase 1 (C4/C2 activating component of Ra-reactive factor)
  ENST ID: ENST00000425937
  CDS Start-End: 388-553
agctcacaggcaagtcaagctgggaggaccaaggccgggcagccgggagcacccaaggcaggaaaatgagggctctgagaagggagctgtgggtgggctgggtgccttccccaggactccaggagacataaaacttgaaacgggagacttcgtgcaaatcctgctccggacgctgctgaagctcagatttctcccactgcctgcacagggtgctgcctgctggcgaatgtgactctcctcctgttcacccacaaggctgatttttccgtgttcctcctctggaaagagcattgctttctctcttccagcactttgtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaa

SEQ ID NO: 151422 - DNA, 542 bp, Homo sapiens
  Payload ID: 9815
  Gene Symbol: MASP1
  Gene Name: mannan-binding lectin serine peptidase 1 (C4/C2 activating component of Ra-reactive factor)
  ENST ID: ENST00000439271
  CDS Start-End: 188-542
agccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggca

SEQ ID NO: 151423 - DNA, 2439 bp, Homo sapiens
  Payload ID: 9816
  Gene Symbol: MASP2
  Gene Name: mannan-binding lectin serine peptidase 2
  Uniprot ID: O00187
  ENST ID: ENST00000400897
  CDS Start-End: 17-2077
gctggacgggcacaccatgaggctgctgaccctcctgggccttctgtgtggctcggtggccacccccttgggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggacattgacgagtgccaggtggccccgggagaggcgcccacctgcgaccaccactgccacaaccacctgggcggtttctactgctcctgccgcgcaggctacgtcctgcaccgtaacaagcgcacctgctcagccctgtgctccggccaggtcttcacccagaggtctggggagctcagcagccctgaatacccacggccgtatcccaaactctccagttgcacttacagcatcagcctggaggaggggttcagtgtcattctggactttgtggagtccttcgatgtggagacacaccctgaaaccctgtgtccctacgactttctcaagattcaaacagacagagaagaacatggcccattctgtgggaagacattgccccacaggattgaaacaaaaagcaacacggtgaccatcacctttgtcacagatgaatcaggagaccacacaggctggaagatccactacacgagcacagcgcagccttgcccttatccgatggcgccacctaatggccacgtttcacctgtgcaagccaaatacatcctgaaagacagcttctccatcttttgcgagactggctatgagcttctgcaaggtcacttgcccctgaaatcctttactgcagtttgtcagaaagatggatcttgggaccggccaatgcccgcgtgcagcattgttgactgtggccctcctgatgatctacccagtggccgagtggagtacatcacaggtcctggagtgaccacctacaaagctgtgattcagtacagctgtgaagagaccttctacacaatgaaagtgaatgatggtaaatatgtgtgtgaggctgatggattctggacgagctccaaaggagaaaaatcactcccagtctgtgagcctgtttgtggactatcagcccgcacaacaggagggcgtatatatggagggcaaaaggcaaaacctggtgattttccttggcaagtcctgatattaggtggaaccacagcagcaggtgcacttttatatgacaactgggtcctaacagctgctcatgccgtctatgagcaaaaacatgatgcatccgccctggacattcgaatgggcaccctgaaaagactatcacctcattatacacaagcctggtctgaagctgtttttatacatgaaggttatactcatgatgctggctttgacaatgacatagcactgattaaattgaataacaaagttgtaatcaatagcaacatcacgcctatttgtctgccaagaaaagaagctgaatcctttatgaggacagatgacattggaactgcatctggatggggattaacccaaaggggttttcttgctagaaatctaatgtatgtcgacataccgattgttgaccatcaaaaatgtactgctgcatatgaaaagccaccctatccaaggggaagtgtaactgctaacatgctttgtgctggcttagaaagtgggggcaaggacagctgcagaggtgacagcggaggggcactggtgtttctagatagtgaaacagagaggtggtttgtgggaggaatagtgtcctggggttccatgaattgtggggaagcaggtcagtatggagtctacacaaaagttattaactatattccctggatcgagaacataattagtgatttttaacttgcgtgtctgcagtcaaggattcttcatttttagaaatgcctgtgaagaccttggcagcgacgtggctcgagaagcattcatcattactgtggacatggcagttgttgctccacccaaaaaaacagactccaggtgaggctgctgtcatttctccacttgccagtttaattccagccttacccattgactcaaggggacataaaccacgagagtgacagtcatctttgcccacccagtgtaatgtcactgctcaaattacatttcattaccttaaaaagccagtctcttttcatactggctgttggcatttctgtaaactgcctgtccatgctctttgtttttaaacttgttcttattga

SEQ ID NO: 151424 - DNA, 726 bp, Homo sapiens
  Payload ID: 9816
  Gene Symbol: MASP2
  Gene Name: mannan-binding lectin serine peptidase 2
  Uniprot ID: O00187
  ENST ID: ENST00000400898
  CDS Start-End: 27-584
ggccaggccagctggacgggcacaccatgaggctgctgaccctcctgggccttctgtgtggctcggtggccacccccttgggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggacattgacgagtgccaggtggccccgggagaggcgcccacctgcgaccaccactgccacaaccacctgggcggtttctactgctcctgccgcgcaggctacgtcctgcaccgtaacaagcgcacctgctcagagcagagcctctagcctcccctggagctccggcctgcccagcaggtcagaagccagagccagcctgctggcctcagctccgggttgggctgagatggctgtgccccaactcccattcacccaccatggacccaataataaacctggccccacccca

SEQ ID NO: 151425 - DNA, 1619 bp, Homo sapiens
  Payload ID: 9817
  Gene Symbol: MPI
  Gene Name: mannose phosphate isomerase
  Uniprot ID: P34949
  ENST ID: ENST00000323744
  CDS Start-End: 33-1121
atacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagacggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgag

SEQ ID NO: 151426 - DNA, 5828 bp, Homo sapiens
  Payload ID: 9817
  Gene Symbol: MPI
  Gene Name: mannose phosphate isomerase
  Uniprot ID: P34949
  ENST ID: ENST00000352410
  CDS Start-End: 68-1339
gggcgcagagggccgcgggggctgccgggaaaggcatacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgaggctgtggggtaatgagcactcagcctttggggtacctgttcctaaagtgggccaaaagagccctccctacatgatgccccagtttttgctttattcctatttcatacagcttctcgggggagtgagcaggctacactccagaacaccggtatgggaaggagtgggagaggaagccagctttggcctcacaggcacagcttgcaagcaggccttgggtctgcccagaggcacagcttgcaagcagccctacagagaaggtgactcaaaggatacaccagtcaccagtgcaagactcttcgctcctgtttttctcttttttttttttttgagacggagtctcggtctgtagcccaggctggagtgcagtggcacgatctcggctcattgcaagctccgcctcccgggttcacgccactcttctgcctcagcctcccaagtagctgggaccacaggcgcccaccaccacgcccagccaatttttttggtatttttagtagagatggggtttcactgtgttagccaggatggtctcgatcttctgacctcgtgatccgcccacctcagcctcccaaagtgctgggattacaggcgtgagccaccacgcctggcccggctcctgtttttcaactggccctagaggaggggtccgcaaaccaggctggcaggccagttctggccatacctgttcatttccatactgtctggctgctttcaagccacagtggcaaagttgaagagttgcactagactgtacggcctgcaaaactgaaaccattgactgtcaaccacttctctacaacatactcaactgttgcagattacagggactcaggaaccgaattagacaattttcatggcgaggagaagcccagttagctttcctaaacgggcaggaagtgtgaaggagggaatctcctgatgccctgctccaggggtggcacacacctgcaagaggctgtcggctgtctgctgctgctgaggtttctgacctgcaatcgtagatcctgtcaccacagactaatcacttagtccactggctccttcctgtgggataaaggtttaaattcatgcaaaagaatctttctgggcttctgcccacactagagtccctatacaatggagttccaggaaaccaccttcaaaaatctcctgggttttcttgcctccaaattttcttcagctaaaaaacaataaagatgagctggaaagaaaaggtctgctaaagggaacccattctacagaagtgacttgcaagagcctatttcactcatgccgtccagtgaaacaggcccgaaagtgatgcccagtgggaacagcagaaaggggagggagtttccagaaggaattgctgtagtcagctgttaagctatttcttcatttcaggatatccaggatattcttaacttttatttttttgagacggagtctcgcactgtctcccgggctggagtgcagtggcgcgatagctcactgcaacctccgcccactgggttcaagcgattcttctgcctcagctcctgagtagctgggactacaggcgcctgccaccacacccagctaagtttttgtatttttagtagagacggggtttcagtagagacggggtgacaggatctacaattccaggtaaggtcaggttggtctcaaactcctgaccttgtgatttgcttgcctcagcctctgaaagtgctgggattacaagcatgagccattgtgcctggccaaggcctttaaaatccactgcaacacagacacagctcaactagtgtgattgcatttattcttataaatgtacagagctgtagaagtgcaagccaagagttctatagagtagtacataaacaccatatggtaccactcctgctgggaggtaagcctggatacacccctctcctcaggaaactgtcacctgcagaacacacagcactcagaattaaggcagtttggccctgggcacattggtggtattttggtatgtggccactggccctaaacaactgaccatttctaccctgcctcactgcactgtcccaccaggtccctccagctttttctacaaggtaacaccctcctacatggggtcagccagctcagaaacctcttcttcagggacagttgcagctgaatatgccagagctgattattacaacaacgatgcagagggccttggttttggggtcctgccaccctcacccctagaagctgctaaacacccaggccattctgccctgaccacctccccaacagagatgtaggtctatacttaccttccacagccacctcccagcacacactgggtccctctacctgtgttgctgtctttctttacactgtgctacatttgatccctttccacatgtgcacttcacctctgcagacacaagaaaggcctggacatggtctctgcagatggggaaggggttctggatggagatgttcttgagctctacaagcatttgcacaaagtgctcagaatgttggccactgcatagagctgcagagtcccattccagaacagagtaaccatctgcctctcttcccaagaccccaagctggcatgactctggtctctgtcctatctctctgctgtgatgctcctagctagtagagtaagtcagcccccagatactgtatattcctctcaaccttccatggtttgagaaaaacacaaagatagatgtccatcaggcactcacaggattaccatcgtaaggatggttgtcagacaaataacaaataaggccgtatctttttattagacttgctcatcttctagtcaccccttgtggtagagcgaaaagagtgtgttgtccctctcatgcctctggtggtcacaggacactgagtaaagcaagagactggatactttcccatgtagaacctataccccaatcccgactattgggctgggaaccctgtctatgcccattcaaagctcaccatgtgggaggactgcttgggcctgggaggttgaggctgcagtgagctgtgattacaccactgcactccagcctgggtgacagagaccctgtctccaacaaaacaaagcagaacgctcaccatggttctgagttaagccaaaaaacaaaacaaaacctgttggaaaaattctagaaagaggcttggtatagagtatagcaagatatactctccaatttgtgggtagggggtgtcacagcagaaattatgcctatttctgctgtttgggctgggggctgaaagaggctgtgtcacacccagaggtctgcttaaagcccaatcctgagtatccagtaaggcccatgctgtgaccagaagaatctggcaatagaatggtccatgctggagtgaagggaggccctctacactggtggactgatttcctcaggcaagggtctaggagctggcttaggtctctcttacccttcctgtctgtaagcctcagtctaggacaaagcccacacagctgtatacccactctcacgagtccattgctacttctcaaaagtttaaaaagtaaacaataggaaggcaccggactgctccctgtagctccctctgctggtaataataaaaactgcaggcttctggggccagccccagtaccttcgacctaatctttagctcaaagactgggtgaagaaactcacccagaccaaggaaatacaaataaataaatatgaacatgtcagagcagtttttctctaactagggaagggcaaaccagaatcactaaactcacccggacggttggaccagttggggatgccccaggtccagggattctggaagccaggatcctgctgtatcattaagcaacctgctatgatccctgtcatagttagacaggtgcaacctgaagagggacaaaaggactcactttatgctgtcttgaaggtcaagcctgcaaaccatcttagagctaggaagaatagagcaaacggaatttctcgaactggtctcaaacagtttcttttttggattgccagctataataaaccataaagtgcta

SEQ ID NO: 151427 - DNA, 1523 bp, Homo sapiens
  Payload ID: 9817
  Gene Symbol: MPI
  Gene Name: mannose phosphate isomerase
  ENST ID: ENST00000535694
  CDS Start-End: 55-1176
atacgtgcttaatcctggtgcagggggcgagcatggccgctccgcgagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagc

SEQ ID NO: 151428 - DNA, 851 bp, Homo sapiens
  Payload ID: 9817
  Gene Symbol: MPI
  Gene Name: mannose phosphate isomerase
  ENST ID: ENST00000561470
  CDS Start-End: 33-248
atacgtgcttaatcctggtgcagggggcgagcatggccgctccgcgaggtgagccattggctggggtgtcggcgagtgtgttcgtggagcgcgtcctggggacgactcccggcattatcggccaggttgagtccgctcctggcattccgcggaaagatggtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttgggga

SEQ ID NO: 151429 - DNA, 1195 bp, Homo sapiens
  Payload ID: 9817
  Gene Symbol: MPI
  Gene Name: mannose phosphate isomerase
  ENST ID: ENST00000564003
  CDS Start-End: 55-741
atacgtgcttaatcctggtgcagggggcgagcatggccgctccgcgagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagacggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggaggtgagccacatttcagcagtgagccccactgccatccctgctgggccctgtttccctatctggacaaaggaaggagaagggtggtcaaggagacccccaaggaccttgcagctctgacctctgagggttcctgggctcagcaagcaacagctggtagggatgatgaatgcatttagcattgaacacgccttgaatcctgacaccaaccctgtgatgccatgctactctgattttaagtcctgccagtcagtgtgggaaccacaatttgaacgcaggctatattggatcaaagctgttgttctgtcacagcctttgtatgtctgtcctacctaccagggatttttacactaaaatatgcatgttgccatggaaggatgccacctttcgactgttggctgcttatccacacatgcctcatgcacaggattctggggtagaagtgggagactacagagttggggctccccaacccccaggggttaacatgactcccctctgacaataatgggtgacctgtcacctgtttttggtatttgatatcttaaccccattctcccagagaatacaattcatggaaatttttacctaacttggcatggggttcatggagctcaggttaggaggcccaga

SEQ ID NO: 151430 - DNA, 1148 bp, Homo sapiens
  Payload ID: 9817
  Gene Symbol: MPI
  Gene Name: mannose phosphate isomerase
  ENST ID: ENST00000565576
  CDS Start-End: 13-807
cagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaaggtggacacagttatattcctggttgggtgcaatgctctggcctgggcttcccagcagacaccagactctggggacagttctcaacccccttgcccaagtggaacactaaaaggggccccacttagatgacctgttggcaacttagcattgcttgcctagtctttgtggagcagggcccttcttagttgagtgctgcttcccaactggtcatcttctccagatggttggaggcagactggcatagaggactcttaggatgccttccacctaggcattctgagattttccctagccctgcagctgccctccatggatggacttgtatctcggggctaaagaggcaggaaggggacacgagcatcctccctctcctggaaaggactgatgcctccagcactcagtcatttgatctttcctttaccttctgtgtgcccaaccttgtgctaagaagagttcaggaaatgac

SEQ ID NO: 151431 - DNA, 555 bp, Homo sapiens
  Payload ID: 9817
  Gene Symbol: MPI
  Gene Name: mannose phosphate isomerase
  ENST ID: ENST00000569233
  CDS Start-End: 33-555
atacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagtggagaaaaagccaaagcataggaaggctttcgcctctgcttctgaaactggaagatttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgagg

SEQ ID NO: 151432 - DNA, 578 bp, Homo sapiens
  Payload ID: 9817
  Gene Symbol: MPI
  Gene Name: mannose phosphate isomerase
  ENST ID: ENST00000568828
  CDS Start-End: 23-578
aatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtt

SEQ ID NO: 151433 - DNA, 969 bp, Homo sapiens
  Payload ID: 9817
  Gene Symbol: MPI
  Gene Name: mannose phosphate isomerase
  ENST ID: ENST00000569931
  CDS Start-End: 104-969
ctgggcgcagagggccgcgggggctgccgggaaaggcatacgtgcttaatcctggtgcagggggcgagcatggccgctccgcgagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtg

SEQ ID NO: 151434 - DNA, 1707 bp, Homo sapiens
  Payload ID: 9817
  Gene Symbol: MPI
  Gene Name: mannose phosphate isomerase
  ENST ID: ENST00000563786
  CDS Start-End: 182-1393
atacgtgcttaatcctggtgcagggggcgagcatggccgctccgcgagtgagcacccccagctcttgcctggtttcccgggacactagggtggggcctgaggagtggagtggcagctgaccctgtctgtgcccctagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatat

SEQ ID NO: 151435 - DNA, 583 bp, Homo sapiens
  Payload ID: 9817
  Gene Symbol: MPI
  Gene Name: mannose phosphate isomerase
  ENST ID: ENST00000564633
  CDS Start-End: 64-583
atacgtgcttaatcctggtgcagggggcgagcatggccgctccgcgagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctc

SEQ ID NO: 151436 - DNA, 2809 bp, Homo sapiens
  Payload ID: 9817
  Gene Symbol: MPI
  Gene Name: mannose phosphate isomerase
  ENST ID: ENST00000566377
  CDS Start-End: 36-899
ggcatacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgaggctgtggggtaatgagcactcagcctttggggtacctgttcctaaagtgggccaaaagagccctccctacatgatgccccagtttttgctttattcctatttcatacagcttctcgggggagtgagcaggctacactccagaacaccggtatgggaaggagtgggagaggaagccagctttggcctcacaggcacagcttgcaagcaggccttgggtctgcccagaggcacagcttgcaagcagccctacagagaaggtgactcaaaggatacaccagtcaccagtgcaagactcttcgctcctgtttttctcttttttttttttttgagacggagtctcggtctgtagcccaggctggagtgcagtggcacgatctcggctcattgcaagctccgcctcccgggttcacgccactcttctgcctcagcctcccaagtagctgggaccacaggcgcccaccaccacgcccagccaatttttttggtatttttagtagagatggggtttcactgtgttagccaggatggtctcgatcttctgacctcgtgatccgcccacctcagcctcccaaagtgctgggattacaggcgtgagccaccacgcctggcccggctcctgtttttcaactggccctagaggaggggtccgcaaaccaggctggcaggccagttctggccatacctgttcatttccatactgtctggctgctttcaagccacagtggcaaagttgaagagttgcactagactgtacggcctgcaaaactgaaaccattgactgtcaaccacttctctacaacatactcaactgttgcagattacagggactcaggaaccgaattagacaattttcatggcgaggagaagcccagttagctttcctaaacgggcaggaagtgtgaaggagggaatctcctgatgccctgctccaggggtggcacacacctgcaagaggctgtcggctgtctgctgctgctgaggtttctgacctgcaatcgtagatcctgtcaccacagactaatcacttagtccactggctccttcctgtgggataaaggtttaaattcatgcaaaagaatctttctgggcttctgcccacactagagtccctatacaatggagttccaggaaaccaccttcaaaaatctcctgggttttcttgcctccaaattttcttcagctaaaaaacaataaagatgagctggaaagaaaa

SEQ ID NO: 151437 - DNA, 857 bp, Homo sapiens
  Payload ID: 9817
  Gene Symbol: MPI
  Gene Name: mannose phosphate isomerase
  ENST ID: ENST00000567570
  CDS Start-End: 500-857
gcatggccgctccgcgaggtgagccattggctggggtgtcggcgagtgtgttcgtggagcgcgtcctggggacgactcccggcattatcggccaggttgagtccgctcctggcattccgcggaaagatgggtgggtgccgggcagaggtgtggccacctgcgatggggattgacctccgaggggagggggcccttctagacgtcgtgccgtgggataggtaccttctgctccctccccgccaccctgcctcagatcagcacaaggtccttactgctgcccatctgacagttgggaacatcgaggcctgcagcggaggggggtctcatccaacagcctacaaaacccttatttgactctgtccccagtgagcacccccagctcttgcctggtttcccgggacactagggtggggcctgaggagtggagtggcagctgaccctgtctgtgcccctagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggcca

SEQ ID NO: 151438 - DNA, 559 bp, Homo sapiens
  Payload ID: 9817
  Gene Symbol: MPI
  Gene Name: mannose phosphate isomerase
  ENST ID: ENST00000567132
  CDS Start-End: 33-559
atacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgt

SEQ ID NO: 151439 - DNA, 1068 bp, Homo sapiens
  Payload ID: 9817
  Gene Symbol: MPI
  Gene Name: mannose phosphate isomerase
  ENST ID: ENST00000567177
  CDS Start-End: 1-642
cagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagacggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactcccttt

SEQ ID NO: 151440 - DNA, 1052 bp, Homo sapiens
  Payload ID: 9817
  Gene Symbol: MPI
  Gene Name: mannose phosphate isomerase
  ENST ID: ENST00000562606
  CDS Start-End: 56-1015
atcctggtgcagggggcgagcatggccgctccgcgagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggaggtgagccacatttcagcagtgagccccactgccatccctgctgggccctgtttccctatctggacaaaggaaggagaagggtggtcaaggagacccccaaggaccttgcagctctgacctctgagggttcctgggctcagcaagcaacagctggtagggatgatgaatgcatttagcattgaacacgccttgaatcctgacaccaaccctgtg

SEQ ID NO: 151441 - DNA, 537 bp, Homo sapiens
  Payload ID: 9817
  Gene Symbol: MPI
  Gene Name: mannose phosphate isomerase
  ENST ID: ENST00000568907
  CDS Start-End: 33-537
atacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttct

SEQ ID NO: 151442 - DNA, 407 bp, Homo sapiens
  Payload ID: 9817
  Gene Symbol: MPI
  Gene Name: mannose phosphate isomerase
  ENST ID: ENST00000562800
  CDS Start-End: 33-407
atacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcttggcactggactctgccagcatcctcctgatggtacaggggacagtaatagccagcacacccacaacccagacaccaatccctctgcaacgtggtggcgtgctcttcattggggcc

SEQ ID NO: 151443 - DNA, 1481 bp, Homo sapiens
  Payload ID: 9817
  Gene Symbol: MPI
  Gene Name: mannose phosphate isomerase
  ENST ID: ENST00000563422
  CDS Start-End: 33-1052
atacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggaggtgagccacatttcagcagtgagccccactgccatccctgctgggccctgtttccctatctggacaaaggaaggagaagggtggtcaaggagacccccaaggaccttgcagctctgacctctgagggttcctgggctcagcaagcaacagctggtagggatgatgaatgcatttagcattgaacacgccttgaatcctgacaccaaccctgtgatgccatgctactctgattttaagtcctgccagtcagtgtgggaaccacaatttgaacgcaggctatattggatcaaagctgttgttctgtcacagcctttgtatgtctgtcctacctaccagggatttttacactaaaatatgcatgttgccatggaaggatgccacctttcgactgttggctgcttatccacacatgcctcatgcacaggattctggggtagaagtgggagactacagagttggggctccccaacccccaggggttaacatgactcccctctgacaataatgggtgacctgtcacctgtttttggtatttgatatcttaaccccattctcccagagaatacaattcatggaaatttttacctaacttggcatggggttca

SEQ ID NO: 151444 - DNA, 5198 bp, Homo sapiens
  Payload ID: 9818
  Gene Symbol: MRC1
  Gene Name: mannose receptor, C type 1
  Uniprot ID: P22897
  ENST ID: ENST00000569591
  CDS Start-End: 123-4493
ttttcagctgggcagctctgggaacttggattaggtggagaggcagttggggggcctcgttgttttgcgtcttagttccgccctcctgtccatcaggagaaggaaaggataaaccctgggccatgaggctacccctgctcctggtttttgcctctgtcattccgggtgctgttctcctactggacaccaggcaatttttaatctataatgaagatcacaagcgctgcgtggatgcagtgagtcccagtgccgtccaaaccgcagcttgcaaccaggatgccgaatcacagaaattccgatgggtgtccgaatctcagattatgagtgttgcatttaaattatgcctgggagtgccatcaaaaacggactgggttgctatcactctctatgcctgtgactcaaaaagtgaatttcagaaatgggagtgcaaaaatgacacacttttggggatcaaaggagaagatttattttttaactacggcaacagacaagaaaagaatattatgctctacaagggatcgggtttatggagcaggtggaagatctatggaaccacagacaatctgtgctccagaggttatgaagccatgtatacgctactaggcaatgccaatggagcaacctgtgcattcccgttcaagtttgaaaacaagtggtacgcagattgcacgagtgctgggcggtcggatggatggctctggtgcggaaccactactgactatgacacagacaagctatttggatattgtccattgaaatttgagggcagtgaaagcttatggaataaagacccgctgaccagcgtttcctaccagataaactccaaatccgctttaacgtggcaccaggcgaggaaaagctgccaacaacagaacgctgagctcctgagcatcacagagattcatgagcaaacatacctgacaggattaaccagttccttgacctcaggactctggattggacttaacagtctgagcttcaacagcggttggcagtggagtgaccgcagtcctttccgatatttgaactggttaccaggaagtccatcagctgaacctggaaaaagctgtgtgtcactaaatcctggaaaaaatgctaaatgggaaaatctggaatgtgttcagaaactgggctatatttgcaaaaagggcaacaccactttaaattcttttgttattccctcagaaagtgatgtgcctactcactgtcctagtcagtggtggccgtatgccggtcactgttacaagattcacagagatgagaaaaaaatccagagggatgctctgaccacctgcaggaaggaaggcggtgacctcacaagtatccacaccatcgaggaattggactttattatctcccagctaggatatgagccaaatgacgaattgtggatcggcttaaatgacattaagattcaaatgtactttgagtggagtgatgggacccctgtaacgtttaccaaatggcttcgtggagaaccaagccatgaaaacaacagacaggaggattgtgtggtgatgaaaggcaaggatgggtactgggcagatcggggctgtgagtggcctcttggctacatctgcaagatgaaatcacgaagccaaggtccagaaatagtggaagtcgaaaaaggctgcaggaaaggctggaaaaaacatcacttttactgctatatgattggacatacgctttcaacatttgcagaagcaaaccaaacctgtaataatgagaatgcttatttaacaactattgaagacagatatgaacaagccttcctgactagtttcgttggcttaaggcctgaaaaatatttctggacaggactttcagatatacaaaccaaagggacttttcagtggaccatcgaggaagaggttcggttcacccactggaattcagatatgccagggcgaaagccagggtgtgttgccatgagaaccgggattgcagggggcttatgggatgttttgaaatgtgatgaaaaggcaaaatttgtgtgcaagcactgggcagaaggagtaacccacccaccgaagcccacgacgactcccgaacccaaatgtccggaggattggggcgccagcagtagaacaagcttgtgtttcaagctgtatgcaaaaggaaaacatgagaagaaaacgtggtttgaatctcgagatttttgtcgagctctgggtggagacttagctagcatcaataacaaagaggaacagcaaacaatatggcgattaataacagctagtggaagctaccacaaactgttttggttgggattgacatatggaagcccttcagaaggttttacttggagtgatggttctcctgtttcatatgaaaactgggcttatggagaacctaataattatcaaaatgttgaatactgtggtgagctgaaaggtgaccctactatgtcttggaatgatattaattgtgaacaccttaacaactggatttgccagatacaaaaaggacaaacaccaaaacctgagccaacaccagctcctcaagacaatccaccagttactgaagatgggtgggttatttacaaagactaccagtattatttcagcaaagagaaggaaaccatggacaatgcgcgagcgttttgcaagaggaattttggtgatcttgtttctattcaaagtgaaagtgaaaagaagtttctatggaaatatgtaaacagaaatgatgcacagtctgcatattttattggtttattgatcagcttggataaaaagtttgcttggatggatggaagcaaagtggattacgtgtcttgggccacaggtgaacccaattttgcaaatgaagatgaaaactgtgtgaccatgtattcaaattcagggttttggaatgacattaactgtggctatccaaacgccttcatttgccagcgacataacagtagtatcaatgctaccacagttatgcctaccatgccctcggtcccatcagggtgcaaggaaggttggaatttctacagcaacaagtgtttcaaaatctttggatttatggaagaagaaagaaaaaattggcaagaggcacgaaaagcttgtataggctttggagggaatctggtctccatacaaaatgaaaaagagcaagcatttcttacctatcacatgaaggactccactttcagtgcctggactgggctgaatgatgtcaattcagaacacacgttcctttggacggatggacgaggagtccattacacaaactgggggaaaggttaccctggtggaagaagaagcagtctttcttatgaagatgctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcatcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctagtacctcaatgcgattctgagatatttgaatttcataaaattgtaactgaaatttaaaatttttagttcaatgtgattgttttctttaaaatgagtactgaattgtactggtctgtccttttttcctttgcctaattgaagaaataattgcttgttttctagcctggcaagatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcaggtacaaatttcctcaagtggcataaaaatgtagtcagttttctcttttaccagtttttatttccactccaattatttagaactttatttgtacatgtgcagaagaataaggcagctgagaatcttgtttcccccaagagagttttacaggctgagtgttgcaaatgtgttctttgtcctgttatatgtatatcaggaatacaaggatgtgaaataaaactgtaaatttgcataactggatgtacttagataatgtgaaataaacattaaagacaaggtctatttttaatagatttgca

SEQ ID NO: 151445 - DNA, 5988 bp, Homo sapiens
  Payload ID: 9819
  Gene Symbol: MRC2
  Gene Name: mannose receptor, C type 2
  Uniprot ID: Q9UBG0
  ENST ID: ENST00000303375
  CDS Start-End: 403-4842
gaaggcgaggcggggagagactgggaaacagagcagcaagagaaagggcgcacgctggggtcctcctggacccggcgtgtcctcctctccgccacccctttctctccctcccgacgctctagccccagacccgcgcctcctccccttcccctcccacgctgcccacttcccttcccctctacccctcgaaccctcctccccggttctgcgctcctccctccgccctccctccgcccgggctgcctcctccctcctcctccccgggaggcatcacttcgtcccgacccggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccggaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacgaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagacgagcgctggggcttctgccccatcaagagtaacgactgcgagaccttctgggacaaggaccagctgactgacagctgctaccagtttaacttccagtccacgctgtcgtggagggaggcctgggccagctgcgagcagcagggtgcggatctgctgagcatcacggagatccacgagcagacctacatcaacggcctcctcactgggtacagctccaccctgtggatcggcttgaatgacttggacacgagcggaggctggcagtggtcggacaactcgcccctcaagtacctcaactgggagagtgaccagccggacaaccccagtgaggagaactgtggagtgatccgcactgagtcctcgggcggctggcagaaccgtgactgcagcatcgcgctgccctatgtgtgcaagaagaagcccaacgccacggccgagcccacccctccagacaggtgggccaatgtgaaggtggagtgcgagccgagctggcagcccttccagggccactgctaccgcctgcaggccgagaagcgcagctggcaggagtccaagaaggcatgtctacggggcggtggcgacctggtcagcatccacagcatggcggagctggaattcatcaccaagcagatcaagcaagaggtggaggagctgtggatcggcctcaacgatttgaaactgcagatgaattttgagtggtctgacgggagccttgtgagcttcacccactggcacccctttgagcccaacaacttccgggacagtctggaggactgtgtcaccatctggggcccggaaggccgctggaacgacagtccctgtaaccagtccttgccatccatctgcaagaaggcaggccagctgagccagggggccgccgaggaggaccatggctgccggaagggttggacgtggcacagcccatcctgctactggctgggagaagaccaagtgacctacagtgaggcccggcgcctgtgcactgaccatggctctcagctggtcaccatcaccaacaggttcgagcaggccttcgtcagcagcctcatctacaactgggagggcgagtacttctggacggccctgcaggacctcaacagcaccggctccttcttctggctcagtggggatgaagtcatgtacacccactggaaccgggaccagcccgggtacagccgtgggggctgcgtggcgctggccactggcagcgccatggggctgtgggaggtgaagaactgtacctcgttccgggcccgctacatctgccggcagagcctgggcactccagtgacgccggagctgccggggccagatcccacgcccagcctcactggctcctgtccccagggctgggcctcggacaccaaactccggtattgctataaggtgttcagctcagagcggctgcaggacaagaagagctgggtccaggcccagggggcctgccaggagctgggggcccagctgctgagcctggccagctacgaggaggagcactttgtggccaacatgctcaacaagatcttcggtgaatcagaacccgagatccacgagcagcactggttctggatcggcctgaaccgtcgggatcccagagggggtcagagttggcgctggagcgacggcgtagggttctcttaccacaatttcgaccggagccggcacgacgacgacgacatccgaggctgtgcggtgctggacctggcctccctgcagtgggtggccatgcagtgcgacacacagctggactggatctgcaagatccccagaggtacggacgtgcgggagcccgacgacagccctcaaggccgacgggaatggctgcgcttccaggaggccgagtacaagttctttgagcaccactccacgtgggcgcaggcgcagcgcatctgcacgtggttccaggccgagctgacctcggtgcacagccaggcggagctagacttcctgagccacaacttgcagaagttctcccgggcccaggagcagcactggtggatcggcctgcacacctctgagagcgatgggcgcttcagatggacagatggttccattataaacttcatctcctgggcaccaggcaaacctcggcctgtcggcaaggacaagaagtgcgtgtacatgacagccagccgagaggactggggggaccagaggtgcctgacagccttgccctacatctgcaagcgcagcaacgtcaccaaagaaacgcagcccccagacctgccaactacagccctggggggctgcccctctgactggatccagttcctcaacaagtgttttcaggtccagggccaggaaccccagagccgggtgaagtggtcagaggcacagttctcctgtgaacagcaagaggcccagctggtcaccatcacaaaccccttagagcaagcattcatcacagccagcctgcccaatgtgacctttgacctttggattggcctccatgcctcgcagagggacttccagtgggtggagcaggagcctttgatgtatgccaactgggcacctggggagccctctggccctagccctgctcccagtggcaacaaaccgaccagctgtgcagtggtcctgcacagcccctcagcccacttcactggccgctgggacgatcggagctgcacggaggagacccatggcttcatctgccagaagggcacggacccctccctgagcccgtccccagcagcgctgccccccgccccgggcactgagctctcctacctcaacggcaccttccggctgcttcagaagccgctgcgctggcacgatgccctcctgctgtgtgagagccgcaatgccagcctggcctacgtgcccgacccctacacccaggccttcctcacgcaggctgcccgagggctgcgcacgccgctctggattgggctggctggcgaggagggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtgggccccctcctccccgaagaataagctaccatggcagctgtccccagggactggcagactccgcgtggattcccttccgggagcactgctattctttccacatggagctgctgctgggccacaaggaggcgcgacagcgctgccagagagcgggtggggccgtcctgtctatcctggatgagatggagaatgtgtttgtctgggagcacctgcagagctatgagggccagagtcggggcgcctggctgggcatgaacttcaaccccaaaggaggcactctggtctggcaggacaacacagctgtgaactactccaactgggggcccccgggcttgggccccagcatgctgagccacaacagctgctactggattcagagcaacagcgggctatggcgccccggcgcttgcaccaacatcaccatgggtgtcgtctgcaagcttcctcgtgctgagcagagcagcttctccccatcagcgcttccagagaacccagcggccctggtggtggtgctgatggcggtgctgctgctcctggccttgctgaccgcagccctcatcctttaccggaggcgccagagcatcgagcgcggggcctttgagggtgcccgctacagccgcagcagctccagccccaccgaggccactgagaagaacatcctggtgtcagacatggaaatgaatgagcaacaagaatagagccaggcgcgtgggcagggccagggcgggaggagctggggagctggggccctgggtcagtctggccccccaccagctgcctgtccagttggcctatggaagggtgcccttgggagtcgctgttgggagccggagctgggcagagcctgggctggtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagagcccgaggagcctcccctgtcccctcgggcagatctgttgtgtctctcttcccacctggcagcctcagctctgtgcccctcaccctgctccctctcgccccttctctcccaccccttccttctgagccgggccctggggattggggagccctcttgttcctgatgagggtcagctgagggggctgagcatccatcactcctgtgcctgctggggtggctgtggggcgtggcaggaggggcctaggtgggttgggcctgagaaccagggcacgggtgtggtgtctgctgggctggagataagactggggagagacaccccaacctcccagggtgggagctgggccgggctgggatgtcatctcctgccgggcgggggagggctctgcccctggaagagtcccctgtggggaccaaaataagttccctaacatctccagctcctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagagaa

SEQ ID NO: 151446 - DNA, 3201 bp, Homo sapiens
  Payload ID: 9819
  Gene Symbol: MRC2
  Gene Name: mannose receptor, C type 2
  ENST ID: ENST00000446119
  CDS Start-End: 1020-2057
atatgatgatccgggggcctctttgtatttggtgcctacttaccatgtactggggggcttgaggcaggaaggaccaggagcacctgggactcagaatttgagcttgtctttttgcccttgggcttcctgccctggagtcctcaggcttcttttctggagcagcaagtgtccagggacagctggggccttatctagaggcaccaggtccttgggtctttgactgccctgagctcagtagctccacccctcagcctacagccactaaaccccagaacctgggcccttccctgcccccattcctgcggccttcattgctgcatccggtggaggcccagctgggggccggtgctggagttacctctgctccatgccattgcagatggacagatggttccattataaacttcatctcctgggcaccaggcaaacctcggcctgtcggcaaggacaagaagtgcgtgtacatgacagccagccgaggctagactcagcgaggggtggacctgtctccatggtccagaagacttgaattcggagctggacacaggccctgagcctctgcccagactcctctcagggcatgaggctgagtgtgctgccagccatgccctgccctgctctgccctgggggtgactgccctcccctcccctttccgcagaggactggggggaccagaggtgcctgacagccttgccctacatctgcaagcgcagcaacgtcaccaaagaaacgcagcccccagacctgccaactacagccctggggggctgcccctctgactggatccagttcctcaacaagtgttttcaggtccagggccaggaaccccagagccgggtgaagtggtcagaggcacagttctcctgtgaacagcaagaggcccagctggtcaccatcacaaaccccttagagcaagcattcatcacagccagcctgcccaatgtgacctttgacctttggattggcctccatgcctcgcagagggacttccagtgggtggagcaggagcctttgatgtatgccaactgggcacctggggagccctctggccctagccctgctcccagtggcaacaaaccgaccagctgtgcagtggtcctgcacagcccctcagcccacttcactggccgctgggacgatcggagctgcacggaggagacccatggcttcatctgccagaagggcacggggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtgggccccctcctccccgaagaataagctaccatggcagctgtccccagggactggcagactccgcgtggattcccttccgggagcactgctattctttccacatggagctgctgctgggccacaaggaggcgcgacagcgctgccagagagcgggtggggccgtcctgtctatcctggatgagatggagaatgtgtttgtctgggagcacctgcagagctatgagggccagagtcggggcgcctggctgggcatgaacttcaaccccaaaggaggcactctggtctggcaggacaacacagctgtgaactactccaactgggggcccccgggcttgggccccagcatgctgagccacaacagctgctactggattcagagcaacagcgggctatggcgccccggcgcttgcaccaacatcaccatgggtgtcgtctgcaagcttcctcgtgctgagcagagcagcttctccccatcagcgcttccagagaacccagcggccctggtggtggtgctgatggcggtgctgctgctcctggccttgctgaccgcagccctcatcctttaccggaggcgccagagcatcgagcgcggggcctttgagggtgcccgctacagccgcagcagctccagccccaccgaggccactgagaagaacatcctggtgtcagacatggaaatgaatgagcaacaagaatagagccaggcgcgtgggcagggccagggcgggaggagctggggagctggggccctgggtcagtctggccccccaccagctgcctgtccagttggcctatggaagggtgcccttgggagtcgctgttgggagccggagctgggcagagcctgggctggtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagagcccgaggagcctcccctgtcccctcgggcagatctgttgtgtctctcttcccacctggcagcctcagctctgtgcccctcaccctgctccctctcgccccttctctcccaccccttccttctgagccgggccctggggattggggagccctcttgttcctgatgagggtcagctgagggggctgagcatccatcactcctgtgcctgctggggtggctgtggggcgtggcaggaggggcctaggtgggttgggcctgagaaccagggcacgggtgtggtgtctgctgggctggagataagactggggagagacaccccaacctcccagggtgggagctgggccgggctgggatgtcatctcctgccgggcgggggagggctctgcccctggaagagtcccctgtggggaccaaaataagttccctaacatctccagctcctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagag

SEQ ID NO: 151447 - DNA, 598 bp, Homo sapiens
  Payload ID: 9819
  Gene Symbol: MRC2
  Gene Name: mannose receptor, C type 2
  ENST ID: ENST00000584682
  CDS Start-End: 1-473
ccttcgtcagcagcctcatctacaactgggagggcgagtacttctggacggccctgcaggacctcaacagcaccggctccttcttctggctcagtggggatgaagtcatgtacacccactggaaccgggaccagcccgggtacagccgtgggggctgcgtggcgctggccactggcagcgccatggggctgtgggaggtgaagaactgtacctcgttccgggcccgctacatctgccggcagagcctgggcactccagtgacgccggagctgccggggccagatcccacgcccagcctcactggctcctgtccccagggctgggcctcggacaccaaactccggtattgctataaggtgttcagctcagagcggctgcaggacaagaagagctgggtccaggcccagggggcctgccaggagctgggggcccagctgctgagcctggccagctacgaggaggagcacttttgaatcagaacccgagatccacgagcagcactggttctggatcggcctgaaccgtcgggatcccagagggggtcagagttggcgctggagcgacggcgtagggttctcttaccacaatttcgaccgga

SEQ ID NO: 151448 - DNA, 574 bp, Homo sapiens
  Payload ID: 9819
  Gene Symbol: MRC2
  Gene Name: mannose receptor, C type 2
  ENST ID: ENST00000579432
  CDS Start-End: 470-574
agaacatatgatgatccgggggcctctttgtatttggtgcctacttaccatgtactggggggcttgaggcaggaaggaccaggagcacctgggactcagaatttgagcttgtctttttgcccttgggcttcctgccctggagtcctcaggcttcttttctggagcagcaagtgtccagggacagctggggccttatctagaggcaccaggtccttgggtctttgactgccctgagctcagtagctccacccctcagcctacagccactaaaccccagaacctgggcccttccctgcccccattcctgcggccttcattgctgcatccggtggaggcccagctgggggccggtgctggagttacctctgctccatgccattgcagatggacagatggttccattataaacttcatctcctgggcaccaggcaaacctcggcctgtcggcaaggacaagaagtgcgtgtacatgacagccagccgagaggactggggggaccagaggtgcctgacagccttgccctacatctgcaagcgcagcaacgtcaccaaagaaacgcagcccccagacctg

SEQ ID NO: 151449 - DNA, 2756 bp, Homo sapiens
  Payload ID: 9820
  Gene Symbol: M6PR
  Gene Name: mannose-6-phosphate receptor (cation dependent)
  Uniprot ID: P20645
  ENST ID: ENST00000000412
  CDS Start-End: 470-1303
ccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaa

SEQ ID NO: 151450 - DNA, 616 bp, Homo sapiens
  Payload ID: 9820
  Gene Symbol: M6PR
  Gene Name: mannose-6-phosphate receptor (cation dependent)
  ENST ID: ENST00000543704
  CDS Start-End: 1-447
ctactactactcctggctgtggcagtgagagaatcctggcagacagaagaaaaaacttgcgacttggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttcccttt

SEQ ID NO: 151451 - DNA, 650 bp, Homo sapiens
  Payload ID: 9820
  Gene Symbol: M6PR
  Gene Name: mannose-6-phosphate receptor (cation dependent)
  ENST ID: ENST00000539143
  CDS Start-End: 1-290
ccatcttacttgtcacgtttgcatcactggttgctgtttatgttgttggggggttcctataccagcgactggtagtgggagccaaaggaatggagcagtttccccacttagccttctggcaggatcttggcaacctggtagcaaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaaca

SEQ ID NO: 151452 - DNA, 660 bp, Homo sapiens
  Payload ID: 9820
  Gene Symbol: M6PR
  Gene Name: mannose-6-phosphate receptor (cation dependent)
  ENST ID: ENST00000544245
  CDS Start-End: 586-660
ggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatc

SEQ ID NO: 151453 - DNA, 2305 bp, Homo sapiens
  Payload ID: 9820
  Gene Symbol: M6PR
  Gene Name: mannose-6-phosphate receptor (cation dependent)
  ENST ID: ENST00000536844
  CDS Start-End: 276-851
atcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaac

SEQ ID NO: 151454 - DNA, 596 bp, Homo sapiens
  Payload ID: 9820
  Gene Symbol: M6PR
  Gene Name: mannose-6-phosphate receptor (cation dependent)
  ENST ID: ENST00000543845
  CDS Start-End: 269-596
agagtggggcacagcgaggcgctagggggaacgctggcctctgaaactagctctgggaccggggtctgcggccggcccctagctggccccgtctcccatccccagaagggtattcactggggattctgagctttggctactccagtttcccacgacactgtaaaagacaactgtacttatgggaagtctagaaacccttgagatttgtgacctgtagaggccaaagaggtttcagaagactacatcaagccatcaaacagtaaagaggatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactc

SEQ ID NO: 151455 - DNA, 720 bp, Homo sapiens
  Payload ID: 9820
  Gene Symbol: M6PR
  Gene Name: mannose-6-phosphate receptor (cation dependent)
  ENST ID: ENST00000543159
  CDS Start-End: 445-720
caatttgttgtcattgatttgtagtgtaaaagacaactgtacttatgggaagtctagaaacccttgagatttgtgacctgtagaggccaaagaggtttcagaagactacatcaagccatcaaacagtaaagaggcaaggatggctccacccaagctgtcatcattcttttttaagttctttcatttccctcttcccaactttgtagtttgttctgaaagactcacctatacattagactacaagttacatataaatgaattttctgctgcagatgctcttgttacagagatattaaaatgtactatgtgttgcatatgccagagaatcttgtactttctggataattaaaataccatcgatttattacacattcatacgctttatctctttcctctctctcctgatcctacctgccctccccaacacacactctctcccaaaggatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaa

SEQ ID NO: 151456 - DNA, 255 bp, Homo sapiens
  Payload ID: 9820
  Gene Symbol: M6PR
  Gene Name: mannose-6-phosphate receptor (cation dependent)
  ENST ID: ENST00000544193
  CDS Start-End: 1-255
gttgttggggggttcctataccagcgactggtagtgggagccaaaggaatggagcagtttccccacttagccttctggcaggatcttggcaacctggtagcagcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacattt

SEQ ID NO: 151457 - DNA, 2198 bp, Homo sapiens
  Payload ID: 9820
  Gene Symbol: M6PR
  Gene Name: mannose-6-phosphate receptor (cation dependent)
  ENST ID: ENST00000541507
  CDS Start-End: 151-552
cacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaaca

SEQ ID NO: 151458 - DNA, 561 bp, Homo sapiens
  Payload ID: 9820
  Gene Symbol: M6PR
  Gene Name: mannose-6-phosphate receptor (cation dependent)
  ENST ID: ENST00000543258
  CDS Start-End: 1-313
gtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggagtcaaaacacttaaccacctgaatgtgttatgccatctcatcatcaggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccact

SEQ ID NO: 151459 - DNA, 581 bp, Homo sapiens
  Payload ID: 9820
  Gene Symbol: M6PR
  Gene Name: mannose-6-phosphate receptor (cation dependent)
  ENST ID: ENST00000537621
  CDS Start-End: 1-368
aagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagtaagtaacagggcagctggttgaatttgtagcctgcaaacaaggttgggtgaccaaccatcctcgtttgttcacactgagggggttcctgggacacaggacattgagtgctaaaaccacaaaagtcccagcaaacaagacagttgccctagtacagagtagtaagtggcacagcatccatttctggccttggtaagacattgctgaaagagcaacactgttgaccagatgggctct

SEQ ID NO: 151460 - DNA, 3569 bp, Homo sapiens
  Payload ID: 9821
  Gene Symbol: MBL2
  Gene Name: mannose-binding lectin (protein C) 2, soluble
  Uniprot ID: P11226
  ENST ID: ENST00000373968
  CDS Start-End: 66-812
ggtaaatatgtgttcattaactgagattaaccttccctgagttttctcacaccaaggtgaggaccatgtccctgtttccatcactccctctccttctcctgagtatggtggcagcgtcttactcagaaactgtgacctgtgaggatgcccaaaagacctgccctgcagtgattgcctgtagctctccaggcatcaacggcttcccaggcaaagatgggcgtgatggcaccaagggagaaaagggggaaccaggccaagggctcagaggcttacagggcccccctggaaagttggggcctccaggaaatccagggccttctgggtcaccaggaccaaagggccaaaaaggagaccctggaaaaagtccggatggtgatagtagcctggctgcctcagaaagaaaagctctgcaaacagaaatggcacgtatcaaaaagtggctcaccttctctctgggcaaacaagttgggaacaagttcttcctgaccaatggtgaaataatgacctttgaaaaagtgaaggccttgtgtgtcaagttccaggcctctgtggccacccccaggaatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaaaaatgatcactaacagcaccaacaaagcaataatagtagtagtagtagttagcagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgtttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcaatgttttcagttctcttgattttcattattcctgtggatgtaaagtgatatttccccatggttttaatctgtatttccccaacatgtaataaggttgaacacttttttatatgcttattgggcacttgggtatcttcttttgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatgtaggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactatagtccagctttgttcttcttaaagtcaagatttccatataaatattagaaacagcttctcaatttctacaaaatcctgatgaggtttctactgggaccacattgagtctatcaatcaacttatgcagaactggcaacttactactgaatctctaatcaatgttcatcatgtatcgcttcatgtaactagaatttctttaacttaattgctatgttttgacatttttagtttaaaaaccttgtatatcttgttttggtggttttagtgattttaataatatattttaaatattttttcttttctattgttgtacacagaaatacagttaagttttgtgtgtagtcttacgatgtttagtaaactcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagatcaggtatagactcctgaaagacaatataatgaagtgctccagtcaggcctatctaaactggattcacagctctgtcacttaattgctacatgatctagagccagttactttgtgtttcagccatgtatttgcagctgagagaaaataatcattcttatttcatgaaaattgtggggatgatgaaataagttaacacctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcaca

SEQ ID NO: 151461 - DNA, 1601 bp, Homo sapiens
  Payload ID: 9822
  Gene Symbol: MPDU1
  Gene Name: mannose-P-dolichol utilization defect 1
  Uniprot ID: O75352
  ENST ID: ENST00000250124
  CDS Start-End: 217-960
aagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtgtaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaa

SEQ ID NO: 151462 - DNA, 840 bp, Homo sapiens
  Payload ID: 9822
  Gene Symbol: MPDU1
  Gene Name: mannose-P-dolichol utilization defect 1
  ENST ID: ENST00000359822
  CDS Start-End: 15-200
gctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgctggggacttacccaagagcaggctgtgtggttcctgggaaccctgctgggaactcagcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtgga

SEQ ID NO: 151463 - DNA, 1125 bp, Homo sapiens
  Payload ID: 9822
  Gene Symbol: MPDU1
  Gene Name: mannose-P-dolichol utilization defect 1
  ENST ID: ENST00000396501
  CDS Start-End: 36-614
ggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgctggggacttacccaagagcaggctgtgtggttcctgggaaccctgctgggaactcagcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtgtaacactatcctgggcaaatgttttaccctgtcctccagcctccctgcttcccttctggccctggaagactgagtctggacggcagagtggaggga

SEQ ID NO: 151464 - DNA, 888 bp, Homo sapiens
  Payload ID: 9822
  Gene Symbol: MPDU1
  Gene Name: mannose-P-dolichol utilization defect 1
  Uniprot ID: O75352
  ENST ID: ENST00000423172
  CDS Start-End: 11-571
gctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggggtgagcatcccattctctcagctctgaggaaggattctggtgtccagagttggctgacctggctggcggtctccactgatagagccatcagtccgattaccacggttacggcggcggcggctgcgattacgacgttgaggtcttgattcatcttctgtagggtaggaaaaaaccagagtcacacatccaacctcccaccctcgattcctacccatctctaactttccagaccccaggcacaccctcacccaggccattctctgtcatgttgggcccatctgattccaggcctccatccatgacggtcctgtcttcatcagtgcggcggcggcgggagcggcggc

SEQ ID NO: 151465 - DNA, 1020 bp, Homo sapiens
  Payload ID: 9822
  Gene Symbol: MPDU1
  Gene Name: mannose-P-dolichol utilization defect 1
  ENST ID: ENST00000571822
  CDS Start-End: 43-228
caatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaag

SEQ ID NO: 151466 - DNA, 1102 bp, Homo sapiens
  Payload ID: 9822
  Gene Symbol: MPDU1
  Gene Name: mannose-P-dolichol utilization defect 1
  ENST ID: ENST00000572936
  CDS Start-End: 198-383
gcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagctgccccaggtgtttaaaatcctgggagccaagagtgctgaagggttgagtctccagtctgtaatgctggagctagtggcattgactgggaccatggtctacagcatcactaacaacttcccattcaggcccgcctttcttcctcccaactcttgactctgcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccaggg

SEQ ID NO: 151467 - DNA, 591 bp, Homo sapiens
  Payload ID: 9822
  Gene Symbol: MPDU1
  Gene Name: mannose-P-dolichol utilization defect 1
  ENST ID: ENST00000570458
  CDS Start-End: 1-184
ggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaag

SEQ ID NO: 151468 - DNA, 917 bp, Homo sapiens
  Payload ID: 9822
  Gene Symbol: MPDU1
  Gene Name: mannose-P-dolichol utilization defect 1
  ENST ID: ENST00000572719
  CDS Start-End: 4-333
aatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcaggcccgcctttcttcctcccaactcttgactctgcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggtttt

SEQ ID NO: 151469 - DNA, 809 bp, Homo sapiens
  Payload ID: 9822
  Gene Symbol: MPDU1
  Gene Name: mannose-P-dolichol utilization defect 1
  ENST ID: ENST00000576272
  CDS Start-End: 1-164
cgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatc

SEQ ID NO: 151470 - DNA, 491 bp, Homo sapiens
  Payload ID: 9822
  Gene Symbol: MPDU1
  Gene Name: mannose-P-dolichol utilization defect 1
  ENST ID: ENST00000576066
  CDS Start-End: 4-231
aatatggcggccgaggcggacggaccgcttaaacggctgctcgtgccgattcttttacctgagaaatgctacgaccaacttttcgttcagtgggacttgcttcacgacatctcctgtctgcttacccttttttctctcctcagtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgccct

SEQ ID NO: 151471 - DNA, 900 bp, Homo sapiens
  Payload ID: 9822
  Gene Symbol: MPDU1
  Gene Name: mannose-P-dolichol utilization defect 1
  ENST ID: ENST00000574558
  CDS Start-End: 1-97
gctgctcgtgccgattcttttacctgagaaatgctacgaccaacttttcgttcagtgggacttgcttcacgctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtgtaacactatcctgggcaaatgttttaccctgtcctccagcctccctgcttcccttctggccctggaagactgagtctgg

SEQ ID NO: 151472 - DNA, 572 bp, Homo sapiens
  Payload ID: 9822
  Gene Symbol: MPDU1
  Gene Name: mannose-P-dolichol utilization defect 1
  ENST ID: ENST00000584479
  CDS Start-End: 4-333
aatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcaggcccgcctttcttcctcccaactcttgactctgcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggagggtgggtaccaggagcaagggacaaga

SEQ ID NO: 151473 - DNA, 728 bp, Homo sapiens
  Payload ID: 9822
  Gene Symbol: MPDU1
  Gene Name: mannose-P-dolichol utilization defect 1
  ENST ID: ENST00000582151
  CDS Start-End: 335-493
agacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacggtgagttttattcagcatccgatccaagtcctactcgagtgaccgtgggcccttagtccaagccttgatcggcgactaagtgacggcagtgactgccgccatgccgagctggacggaagtcacttctgagaagggcggaagtgtctcgggctccttagagggaggacaccatattagtgccagtggggaagtcaccgggtggaattacttctttgtggagtttgtgctgtagcgacaatgaaaaacgaagagtcaacttttataaaacaaaataaaaattaagtcaaatca

SEQ ID NO: 151474 - DNA, 475 bp, Homo sapiens
  Payload ID: 9822
  Gene Symbol: MPDU1
  Gene Name: mannose-P-dolichol utilization defect 1
  ENST ID: ENST00000584378
  CDS Start-End: 12-475
agctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagcttctccaggcagccaccaactaccacaacgggcacacaggccagctctcagccatcacagtcttcctgctgtttgggggctccctggcccgaatcttcacttccattcaggggtgagcatcccattctctcagctctgaggaaggattctggtgtccagag

SEQ ID NO: 151475 - DNA, 438 bp, Homo sapiens
  Payload ID: 9822
  Gene Symbol: MPDU1
  Gene Name: mannose-P-dolichol utilization defect 1
  ENST ID: ENST00000585217
  CDS Start-End: 1-351
gcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtctaggcggaagggagtggagatggggctggttcctgctgcagtgaggggaacagatgggacaataaagactggagactcagttgaataata

SEQ ID NO: 151476 - DNA, 714 bp, Homo sapiens
  Payload ID: 9822
  Gene Symbol: MPDU1
  Gene Name: mannose-P-dolichol utilization defect 1
  ENST ID: ENST00000580834
  CDS Start-End: 12-341
agctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcaggcccgcctttcttcctcccaactcttgactctgcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctct

SEQ ID NO: 151477 - DNA, 456 bp, Homo sapiens
  Payload ID: 9822
  Gene Symbol: MPDU1
  Gene Name: mannose-P-dolichol utilization defect 1
  ENST ID: ENST00000581380
  CDS Start-End: 1-456
cggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaagcttctccaggcagccaccaactaccacaacgggcacacaggccagctctcagccatcacagtcttcctgctgtttgggggctccctggcccgaatctt

SEQ ID NO: 151478 - DNA, 582 bp, Homo sapiens
  Payload ID: 9822
  Gene Symbol: MPDU1
  Gene Name: mannose-P-dolichol utilization defect 1
  ENST ID: ENST00000579445
  CDS Start-End: 2-582
tatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggagggcagccaccaactaccacaacgggcacacaggccagctctcagccatcacagtcttcctgctgtttgggggctc

SEQ ID NO: 151479 - DNA, 563 bp, Homo sapiens
  Payload ID: 9822
  Gene Symbol: MPDU1
  Gene Name: mannose-P-dolichol utilization defect 1
  ENST ID: ENST00000580708
  CDS Start-End: 12-317
agctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcaggtgaggggcccacccttccaccccaagggtaatacccacaactctaatggggattaaggtgaaggaggttacaaggcagcaaagtggccgggcccagtggcttgcacctgtaaccccagcactttgggaggccgaggttgcagtgagccaagattgcgccactgcactccagcctgggcaacaagagcgaaactcagtcttaaaaaaaaaaaaaagggacaaggggctaggaaagttttaagccctttta

SEQ ID NO: 151480 - DNA, 1614 bp, Homo sapiens
  Payload ID: 9822
  Gene Symbol: MPDU1
  Gene Name: mannose-P-dolichol utilization defect 1
  ENST ID: ENST00000621041
  CDS Start-End: 217-1116
aagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtgtaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactacc

SEQ ID NO: 151481 - DNA, 1615 bp, Homo sapiens
  Payload ID: 9822
  Gene Symbol: MPDU1
  Gene Name: mannose-P-dolichol utilization defect 1
  ENST ID: ENST00000620608
  CDS Start-End: 217-852
aagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaacaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtgtaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactacc

SEQ ID NO: 151482 - DNA, 900 bp, Homo sapiens
  Payload ID: 9822
  Gene Symbol: MPDU1
  Gene Name: mannose-P-dolichol utilization defect 1
  ENST ID: ENST00000614740
  CDS Start-End: 1-900
atggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcccctgctccggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttga

SEQ ID NO: 151483 - DNA, 5014 bp, Homo sapiens
  Payload ID: 9823
  Gene Symbol: MAN1A1
  Gene Name: mannosidase, alpha, class 1A, member 1
  Uniprot ID: P33908
  ENST ID: ENST00000368468
  CDS Start-End: 443-2404
agtgctcgcggggccgcggcggagtgtaccgtgctgctctactcgctgccattcgcccgcaggtcggcgcgctcgcccacctgagccgcgccggggctgcgggaccgtgggacagcgcgctcagcccagcctaggaaagaggcagcagtctcagcgcggagatggggagcgggcgaagttgacgagtctcccgcccacgctgcgcccctcctgcccagaggggctgcagccagcggtctgtcgcgcgtgcctgtgtgcccgaggagccgccccggggagaagacccggcgcggagttgttcccccagggaggatccgcagcccagccgagggggtcgggcggcctggctacgcaggacccagccccgcagccgcggactcccagcggcggcgaagtttggctgctgagcggcgcggcgccggaccactggacagcgggagcgatgcccgtggggggcctgttgccgctcttcagcagccccgcgggcggcgtcctgggcggggggctcggcggcggcggtggcaggaaggggtcgggccccgccgccctccgcctgacggagaagttcgtgctgctgctggtattcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaagtggtattggaaggaactggccctgggcctctggaggcagcagtattctggcagaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgcggggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccccactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtcaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatata

SEQ ID NO: 151484 - DNA, 8576 bp, Homo sapiens
  Payload ID: 9824
  Gene Symbol: MAN1A2
  Gene Name: mannosidase, alpha, class 1A, member 2
  Uniprot ID: O60476
  ENST ID: ENST00000356554
  CDS Start-End: 736-2661
agacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacagtcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagagatgatgaaacatgcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaaatgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaacttacaactttatttatgtggcttggcaaaaatcactataaggcagctctaaatttgccttgataagctaaataaattacttttataacttactaaagcagaacaaacagtgaaactttctaaaatattctatctggaatagggacaggggatcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactgatccgtaaatgataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtagaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgacttgccagtgtcatgttttatttttgttatagatttttaaattatttccttcaagatcaattcttatcccatataatgcttagcttccaagaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcacaaatgtgcagaatagatacatcagttggtgcataatcgaaaaaaataggaattttgaacactgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcaggtggttcttactttcttgtgggttgcacattttgtatctctctaacatcagcgtattcctgactttaagcaggtgtttatatgtaaaataaaacctgggtatcgaagggaaatgcattctttttatggagtattgaccctgatcctctatgatgtcatatagagcaactcagggctatacttgctagattttaaccaagcagtttgaaatattaatcatcatcctctcatcttctccactctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtatgagagtagctcacaacattttaaatgtttccaatatgaatcgtgttacaaaattcttaattttatatttcatataaattaaagaggaaaaagaaaaggtttataatatattttaaaacaatgtgttactgtataatacaactataattgtagttaataactaaaacctcttgaaaatgtcaaagaaatacttgatttctgatgcaactttgactaaaatatttactttagaaataaaaacgttcttattttgctatatcactttaattgcataattaaaaagcagtgttttatagaaatgctggttattttatattcaaaaagattttgtcacataattcatgggtaaaacttgcagttgtaaattgtgtctgctctggtatgggccctattaatagtcccatgctgttaaatataaagaaaaatatactaaaatattcaaagttccaaataacagttcctagtaatagtattttgagttatttttctttaggtttccttatactcaaattggctaggtcctatcttttcctctctctctctctctctctctctctctctctctctctctatatatatatatatatatatatatatatgagagatatatgagatatatgagagatcaagatctatatatgtatataaatacaattatacacagataatttttaatactctttgttaacaaacacagttgaaaactggtttcggctgcacaaataagcagaatatttgagtaactatatatgatatggagatattttaatccatttatcctggctcaagaacactgataaagatgattttctgttactttagctcattcagatcaggatggacatgctctttttgatctataactgttcagccagcttccagataatattttaggctatgagagctatacagtctctcttattactcatttctgctgttgaagtatcgaaaacagatagagatactatgtaaagaatgggcgtagctatgttccaggaaaactttatttacaaaagcagatggagggctggatttggtccatgggtcatagttagtgaccctgatcccaagtttattttgtgttagaccctctaacctttgatctgcgtcttttctgttttgatttacataattcatttttaaatcaaaaagatgtgcgtatatatggttgtgtgtatctgtataacctaaagctataatattttgttgtcttgaaagcagatacactcttcctggagtctgttcaggtttcaggacgattgactataatgaaagagacagaatagggtaagggaagatgggtatgctatcagccattttctttgccttgtcatttaatgccataatttcagattctctatgtaaaaagaaggtctgtgtattgtcaaaataatatactctccaagttctcctgctcattgacccttgaaccaggattctggattgctagagctgcagaaattcacccacttgggtactcttagagctctacagcaagaatatgatagaatgtctgatctttgtgctgcagaaagcaaacttttgaagaattctaagcaacagaaaatgggttatgtgactcatctgctatttggcagccactattccttttttagactgcagaacggtactgcccctgttacctctagaatagcctgagtctgaggagtgcagagaaaagatatatccaaaaggagaatccctttctcttgcataactctcaatcctttacaagtaagtagcattatttcagaatgtctatatgcatcattttcaactaaagcatacctcatccttaaacttccactatttaacagctaatccatttcaaacttggtttgagcctagcaattgcagaactcataaaattgcttgtgaaattacacaccatattactagcatatacattgcagtgctccaatcatgctaacagataatagatttttctttaagaattttatcaaatatttcactatttggggaaattttagaggaggggaagcctgtattcaggatgatagagggagcagagacttactgtctctcttccacattataaatgaactgcctttccaggtccaacatgctgtcaggttgcttcagctcggtgtgaatgtaagtgtggggatcaaacacacacacctatacacatacatattaatatgcagaggattttaaataattgcaaatgtcttgtggctgttttatttctacaaaattctgtaagatgtataccagaaaacataataaagataagctcagttcttcattgggaaaaaatatttttaaagaaaatttagaagtttttgctgaattaaagtatcttcaattttaattactggatttggaagttgaaatgccatccttcaatatcactggtctcaaattcattgatagaattttttcttaaactaataagtggggtaagtataatctcctaaattggtacccactggctgctcctaaactggtttccagtcatgtcctccagtatgtgatttttataaattaaaggtaatattgtatattaaagttcaaataaagatgttctttaagtgaaaa

SEQ ID NO: 151485 - DNA, 678 bp, Homo sapiens
  Payload ID: 9824
  Gene Symbol: MAN1A2
  Gene Name: mannosidase, alpha, class 1A, member 2
  ENST ID: ENST00000421535
  CDS Start-End: 1-613
tattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcagagtcctgaagtctggaggctagacttcctgaaagcaagtcaagaatatagagcaccttgcaggagttcaagat

SEQ ID NO: 151486 - DNA, 487 bp, Homo sapiens
  Payload ID: 9824
  Gene Symbol: MAN1A2
  Gene Name: mannosidase, alpha, class 1A, member 2
  ENST ID: ENST00000422329
  CDS Start-End: 1-294
gaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatga

SEQ ID NO: 151487 - DNA, 2082 bp, Homo sapiens
  Payload ID: 9824
  Gene Symbol: MAN1A2
  Gene Name: mannosidase, alpha, class 1A, member 2
  ENST ID: ENST00000449370
  CDS Start-End: 1-995
acattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaattagcctcctaccatgagagaactgtttttccagctggatgaaaagagtagcatcaagtcccctattctgctgttttctgctcacttactcctggagacaagctaagtcaaatcaatatgtacttataagtacctgctttctcagagttgtatttgagaattaaagtatatgaaatgtatactctacccataaatagcttggagtctggtttagaaatctcttacctttaggcatggacaaatttaataaaagtacaaagtatatatgcagttggccctccatgtcaatgggttcatggattcaaccaaacatggattgaagatatagttttttaaaaattacatctgttttgagcatgtatatacctttttcttgtcattattccctaggcaatataacaactatttacatagatttaaagtatgtgggagcatatgcattggttatatgaatatactataccattttatatcaaggatttgagcattcaaggatttttgtatctgcgagaggtcctggaaccaatcccccatagatactgagggacaactgtattcagtgctaaatagaaaataaatgttttagaaattcagagaagggaattttggtgcaggccagagtagtcatgaagaaagactaaaatgatgctgaattagtaagatgttaataggtggggtaaaacagaaagtagctttgtgaaaagaaggattcagcctgaaaaaatacctttaaaaaaacactaaagaaactagaccgactaaagtacattcactaggagaagtagtaggaaataagagctctagaatcaaaatcagggaagcagcatggatgacccttgaggacattatgctaagtgaaataagtcagccataaaaagacaaatatggggtgattccacttctatgaggtctctaaagtagtcacatttatggaaacaaagtagaatgttggttaccagggacctggggaggggaatggaaatgagttttagttttgcaaagaacagtgtgaatatacttaatactactgaactatacgctgaaaaatggtgaagatggtaaactttatgtcatgtgtttattaccacaat

SEQ ID NO: 151488 - DNA, 2769 bp, Homo sapiens
  Payload ID: 9825
  Gene Symbol: MAN1B1
  Gene Name: mannosidase, alpha, class 1B, member 1
  Uniprot ID: Q9UKM7
  ENST ID: ENST00000371589
  CDS Start-End: 74-2173
actggccgcatagagacgcagcgcacgcgcagtcgcgtatccgtgtgatgggcgggctgttgacggcgctgcgatggctgcctgcgagggcaggagaagcggagctctcggttcctctcagtcggacttcctgacgccgccagtgggcggggccccttgggccgtcgccaccactgtagtcatgtacccaccgccgccgccgccgcctcatcgggacttcatctcggtgacgctgagctttggcgagaactatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggatgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaccgc

SEQ ID NO: 151489 - DNA, 573 bp, Homo sapiens
  Payload ID: 9825
  Gene Symbol: MAN1B1
  Gene Name: mannosidase, alpha, class 1B, member 1
  ENST ID: ENST00000545539
  CDS Start-End: 1-159
ccttgggccgtcgccaccactgtagtcatgtacccaccgccgccgccgccgcctcatcgggacttcatctcggtgacgctgagctttggcgagaactatgacaacagcaagagttggcggcggcgctcgtgctggagggtgagggtcgcgccgggctgactggggcccggggctgccgtgcccgccgccctcccagactgcggctccgagcgggacctgggcgggcggactcgactccccaggcgccgccctctccaccccttccccgcaaaaaggggcaaataaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagat

SEQ ID NO: 151490 - DNA, 2296 bp, Homo sapiens
  Payload ID: 9825
  Gene Symbol: MAN1B1
  Gene Name: mannosidase, alpha, class 1B, member 1
  ENST ID: ENST00000535144
  CDS Start-End: 29-2116
cccttgggccgtcgccaccactgtagtcatgtacccaccgccgccgccgccgcctcatcgggacttcatctcggtgacgctgagctttggcgagaactatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtgagcacctgtcctcgccccgcgtggtcacggccaccgggccacaggcacggctgggctgtggggctcaggctggctccgctcttggtggtggctgtgacctggatccgggaggggcgggcttgccgcagcctcggggtggccacactgcagcttgggggccctggcatccccatccccactgagcttcatggttgtgggacccagagtacttggaggggctgggcacccctcattttcatttctcagggcctgtctagggagggtctctgctgtgggcccagcatccccccagtttaggaggcacacgcacccatgactggggcaccatccccactgtggaccaggccctgttttaggtcacgccctccacgccagagtgtcacttcctggctctgctgtgatcttggcctgaggcccccgctgcctccgctcccaccgtctgccctgtgccctgtgccctgtgcggcaactgtgagg

SEQ ID NO: 151491 - DNA, 545 bp, Homo sapiens
  Payload ID: 9825
  Gene Symbol: MAN1B1
  Gene Name: mannosidase, alpha, class 1B, member 1
  ENST ID: ENST00000542372
  CDS Start-End: 1-545
ttgggccgtcgccaccactgtagtcatgtacccaccgccgccgccgccgcctcatcgggacttcatctcggtgacgctgagctttggcgagaactatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggcca

SEQ ID NO: 151492 - DNA, 2090 bp, Homo sapiens
  Payload ID: 9825
  Gene Symbol: MAN1B1
  Gene Name: mannosidase, alpha, class 1B, member 1
  ENST ID: ENST00000544448
  CDS Start-End: 16-1668
gttgacggcgctgcgatggctgcctgcgagggcaggagaagcggagctctcggttcctctcagtcggacttcctgacgccgccagtgggcggggccccttgggccgtcgccaccactgtagtcatgtacccaccgccgccgccgccgcctcatcgggacttcatctcggtgacgctgagctttggcgagaactatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatgggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggatgcctacgtgttcaacaccgaagcccaccctctgcctatctggacccctgcctag

SEQ ID NO: 151493 - DNA, 905 bp, Homo sapiens
  Payload ID: 9825
  Gene Symbol: MAN1B1
  Gene Name: mannosidase, alpha, class 1B, member 1
  ENST ID: ENST00000475449
  CDS Start-End: 1-811
cttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacggcctggatgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtc

SEQ ID NO: 151494 - DNA, 774 bp, Homo sapiens
  Payload ID: 9825
  Gene Symbol: MAN1B1
  Gene Name: mannosidase, alpha, class 1B, member 1
  ENST ID: ENST00000550113
  CDS Start-End: 1-373
ggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggatcctcagaagcccgagcctagggacaagatggagagcttcttcctgggggagacgctcaagtatctgttcttgctcttctccgatgacccaaacctgctcagcctggatgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaaggg

SEQ ID NO: 151495 - DNA, 1485 bp, Homo sapiens
  Payload ID: 9825
  Gene Symbol: MAN1B1
  Gene Name: mannosidase, alpha, class 1B, member 1
  ENST ID: ENST00000371587
  CDS Start-End: 1-348
ccttgggccgtcgccaccactgtagtcatgtacccaccgccgccgccgccgcctcatcgggacttcatctcggtgacgctgagctttggcgagaactatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctccaggaggcatatatggcaacgaattggcaagaaatcaagataaagagaaaggtagagctgtatgtaaccacctggctagaacacagatgttaatttgatgctgtctgactactttctaggtctctggtctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggtaagggggcaggctttctggctggatgcgcctcccctggagctaccttttgctcatcacagcaggtactgtgtgtgtgtgtgtatgtgcatgtgtgttttcaggttttttactgtgataaaacacacaaaacgcaccaccttaaccatttccaggcgtggtcggtggtgttacattcacg

SEQ ID NO: 151496 - DNA, 2627 bp, Homo sapiens
  Payload ID: 9826
  Gene Symbol: MAN1C1
  Gene Name: mannosidase, alpha, class 1C, member 1
  ENST ID: ENST00000263979
  CDS Start-End: 614-1966
ggctgccgcagaagttcctcttcctcctcttcctctcgggcctggtcaccctgtgcttcggggccctcttcctgctgccccactcctctcgcctcaagcgcctcttcctggccccccggacccagcagcctggtctggaagtggtggctgaaatcgccggccatgccccggcccgcgagcaggagccgcctcccaacccggcccccgccgcgccggccccgggcgaggatgaccccagcagctgggccagtccccgccgcaggaaaggggggctgcggcgcacccgccccactggaccccgcgaggaggccacggcggcccggggcaatagcatcccggcctccaggcccggggacgagggcgtccctttccgctttgacttcaacgcattccggagccgtctccgccacccggtcctgggaacgagggccgatgagagtcaggagccccagagccaagtgcgagcccagcgggagaaaatcaaggagacacagcggtcctggggttgccttccagatgaagatctatcaaagatttgaagtcttgtgtatgtggtcctagaggaccccaggctgttataccgatccatgaggcatctgaccccttccaaaggatgatgcagtttgcttggcagagctataagcgttatgcaatggggaaaaacgaactccgtccactaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaa

SEQ ID NO: 151497 - DNA, 2461 bp, Homo sapiens
  Payload ID: 9826
  Gene Symbol: MAN1C1
  Gene Name: mannosidase, alpha, class 1C, member 1
  ENST ID: ENST00000374329
  CDS Start-End: 595-1800
gtcctttaagttgcaagggcctggggtggcaggggtagaggaatgcatgaagattcctcaccaatgcctgatactgtcagtcttcgtaacgttagcctttctagcagaaggaaactctatctatctatctatctatctatatttatttattttatttttttgagatggagtctcactcttgtcgcccagactggagtgcagtggcatagtctcggctcactgcaacttctgcctcccgggttcaagcgattctcctgcctcagcctcccgagtagctaggattacaggcgcccgcaaccacgcccagctaatttttgtatttttagtagagacagggtttcactgtgttggccaggctggtctcgaactcctgacctcaggcgatctgcctgccttggcctcccaaagtgctgggattacaggcatgagccactgagcccagctggaaacactatattcttgttgagcccctggaagtttatttatatactcattctgcatttttgttcaatccatactctgctaagcactggagaaaacagaggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaa

SEQ ID NO: 151498 - DNA, 4641 bp, Homo sapiens
  Payload ID: 9826
  Gene Symbol: MAN1C1
  Gene Name: mannosidase, alpha, class 1C, member 1
  Uniprot ID: Q9NR34
  ENST ID: ENST00000374332
  CDS Start-End: 331-2223
aaggcgcgggccccggcgcggcggggagggctcggccggaggggaggctgcggcgcgcggccggtcgctgcgggcccgggccccaagccgtgccgctccgctcgcccgggccccgccgaggccgctgcgcccccgcctcctcgcgggaggactcgctccaaactccctgaacttcggggacagtcccccgaagcggcgaaactctcagggttggcaaccctgcccagggacccccatcccgggcggcgctccggacgccctcccctcaccgcgcccccgcagacacgtgcctggactccgagggcttctggagccaccggccgggccacgatgctcatgaggaaagtgcccggcttcgtcccggcctccccgtgggggctgcggctgccgcagaagttcctcttcctcctcttcctctcgggcctggtcaccctgtgcttcggggccctcttcctgctgccccactcctctcgcctcaagcgcctcttcctggccccccggacccagcagcctggtctggaagtggtggctgaaatcgccggccatgccccggcccgcgagcaggagccgcctcccaacccggcccccgccgcgccggccccgggcgaggatgaccccagcagctgggccagtccccgccgcaggaaaggggggctgcggcgcacccgccccactggaccccgcgaggaggccacggcggcccggggcaatagcatcccggcctccaggcccggggacgagggcgtccctttccgctttgacttcaacgcattccggagccgtctccgccacccggtcctgggaacgagggccgatgagagtcaggagccccagagccaagtgcgagcccagcgggagaaaatcaaggagatgatgcagtttgcttggcagagctataagcgttatgcaatggggaaaaacgaactccgtccactaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaatatgattgggctcattgcacatcagtgactcctagaaaaaccattgcaatgttaccatcagaaataataatcagccagcagttgatttaaggtataatttagtaaacgattccaacttctattacctcccctgaaatcggtcctgatatattcgagaagcatgaggccagcccttcagatgcagttgtttatttatactcaggtttagattgggaagaggcccagggaggagcagcaacttgcctgaggtcacacagcccaaaaaaggcaaaggagagtctcgcccctgccgtctcctggccaccccagttgagtgtccgtctgttccatcattcagcagatgcttggtgagtgcctgcaacggaccagacactgggctagaggccagggacaccgctgagagtgagacagtcataagccctgcagtcaaggggtcaagaggggagaaagcgatggtaagggaaactgacaagtaagtgaagtgactgcaggtcataggaaatgctacaaaggagatagatagacagctgaggacctaccctacggggtcagggagggcctctctgggcaggtgaccttcaagccaagacccagaagataaaaaggagcagccgaaagactatctggcagaagaatgaacttcccataacccagccccctttcccaccctccctgatgccctccctgggagggggcctgaaacactggggctgttgtgcagagcaaggagctcaggtcctaacactgaagtgacagctcttcctcccctgacccttttttttttttgagacccagagtctcgttcagtcgcccaggctggagtgcagtggtgcaatcttggctcactgcaacctccacctcctgggttcaagcagttctcctgcctcagcttccccagtagcagggtgcgtcaccacacccggctaattttttgtatttttagtaaagacgaggttttgccatgttgcctaggctggtcttgaactcctgagctcaggtgatccgcccacctcagcctcccaaagtgcggggattacaggcatgagccaccacacccagtcctttcctggcacatttgcagcttgtcaacacagcggaaatcacgggagaatgttgagcccttccctgggctcagctgcttgctctgttcataagctttaatagcccccggggctctgggccaggtgacccggctttaaatccctgctgtgtgaacttaggcaggtacctcccctctctgggctcttcttttccatcaagcagacagaaaacctcaaccccacaaggttgctgtgagaagaagtgggaagctgctggttccctgggcacaggaagtgcttgttccttgttctggagactcaagacattcccagaatcttcttaagcagagctgctggggagtagcccctgtagcaagtaccatgctcttgacaggcagcatgagagcgtgactcccatgacccacctgtgctcaaaaaaaaaaaaaaaaaaaagcaaaccaggaaaactgactacacaaacattgtagaaagattagaaaatagaagcagaaagaagactcattggccatcccactctctggggtgaatactgttatattttcttctaggcctttttctatgaatatatagaatatagattttgccaccgtggtatcctactatgcacactgttttcttataatctgcttttgcacttaactgtacattgtgaacctctttccatgtcaacaaatacatgtttatctcatcgctgta

SEQ ID NO: 151499 - DNA, 4647 bp, Homo sapiens
  Payload ID: 9826
  Gene Symbol: MAN1C1
  Gene Name: mannosidase, alpha, class 1C, member 1
  ENST ID: ENST00000611903
  CDS Start-End: 961-2049
aaggcgcgggccccggcgcggcggggagggctcggccggaggggaggctgcggcgcgcggccggtcgctgcgggcccgggccccaagccgtgccgctccgctcgcccgggccccgccgaggccgctgcgcccccgcctcctcgcgggaggactcgctccaaactccctgaacttcggggacagtcccccgaagcggcgaaactctcagggttggcaaccctgcccagggacccccatcccgggcggcgctccggacgccctcccctcaccgcgcccccgcagacacgtgcctggactccgagggcttctggagccaccggccgggccacgatgctcatgaggaaagtgcccggcttcgtcccggcctccccgtgggggctgcggctgccgcagaagttcctcttcctcctcttcctctcgggcctggtcaccctgtgcttcggggccctcttcctgctgccccactcctctcgcctcaagcgcctcttcctggccccccggacccagcagcctggtctggaagtggtggctgaaatcgccggccatgccccggcccgcgagcaggagccgcctcccaacccggcccccgccgcgccggccccgggcgaggatgaccccagcagctgggccagtccccgccgcaggaaaggggggctgcggcgcacccgccccactggaccccgcgaggaggccacggcggcccggggcaatagcatcccggcctccaggcccggggacgagggcgtccctttccgctttgacttcaacgcattccggagccgtctccgccacccggtcctgggaacgagggccgatgagagtcaggagccccagagccaagtgcgagcccagcgggagaaaatcaaggagatgatgcagtttgcttggcagagctataagcgttatgcaatggggaaaaacgaactccgtccactaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggcaacagtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggagggtcaaggtggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaatatgattgggctcattgcacatcagtgactcctagaaaaaccattgcaatgttaccatcagaaataataatcagccagcagttgatttaaggtataatttagtaaacgattccaacttctattacctcccctgaaatcggtcctgatatattcgagaagcatgaggccagcccttcagatgcagttgtttatttatactcaggtttagattgggaagaggcccagggaggagcagcaacttgcctgaggtcacacagcccaaaaaaggcaaaggagagtctcgcccctgccgtctcctggccaccccagttgagtgtccgtctgttccatcattcagcagatgcttggtgagtgcctgcaacggaccagacactgggctagaggccagggacaccgctgagagtgagacagtcataagccctgcagtcaaggggtcaagaggggagaaagcgatggtaagggaaactgacaagtaagtgaagtgactgcaggtcataggaaatgctacaaaggagatagatagacagctgaggacctaccctacggggtcagggagggcctctctgggcaggtgaccttcaagccaagacccagaagataaaaaggagcagccgaaagactatctggcagaagaatgaacttcccataacccagccccctttcccaccctccctgatgccctccctgggagggggcctgaaacactggggctgttgtgcagagcaaggagctcaggtcctaacactgaagtgacagctcttcctcccctgacccttttttttttttgagacccagagtctcgttcagtcgcccaggctggagtgcagtggtgcaatcttggctcactgcaacctccacctcctgggttcaagcagttctcctgcctcagcttccccagtagcagggtgcgtcaccacacccggctaattttttgtatttttagtaaagacgaggttttgccatgttgcctaggctggtcttgaactcctgagctcaggtgatccgcccacctcagcctcccaaagtgcggggattacaggcatgagccaccacacccagtcctttcctggcacatttgcagcttgtcaacacagcggaaatcacgggagaatgttgagcccttccctgggctcagctgcttgctctgttcataagctttaatagcccccggggctctgggccaggtgacccggctttaaatccctgctgtgtgaacttaggcaggtacctcccctctctgggctcttcttttccatcaagcagacagaaaacctcaaccccacaaggttgctgtgagaagaagtgggaagctgctggttccctgggcacaggaagtgcttgttccttgttctggagactcaagacattcccagaatcttcttaagcagagctgctggggagtagcccctgtagcaagtaccatgctcttgacaggcagcatgagagcgtgactcccatgacccacctgtgctcaaaaaaaaaaaaaaaaaaaagcaaaccaggaaaactgactacacaaacattgtagaaagattagaaaatagaagcagaaagaagactcattggccatcccactctctggggtgaatactgttatattttcttctaggcctttttctatgaatatatagaatatagattttgccaccgtggtatcctactatgcacactgttttcttataatctgcttttgcacttaactgtacattgtgaacctctttccatgtcaacaaatacatgtttatctcatcgctgt

SEQ ID NO: 151500 - DNA, 4667 bp, Homo sapiens
  Payload ID: 9827
  Gene Symbol: MAN2A1
  Gene Name: mannosidase, alpha, class 2A, member 1
  Uniprot ID: Q16706
  ENST ID: ENST00000261483
  CDS Start-End: 1053-4487
ggcggggccagccgcccgctcggctcaggcgctgcgggcgcctattgacccagcggctgctgcgccgccgctgtctcctcctgctcgtggcgggcggtgctggagcgccaagtggcgctggagaaccggcgcttcctttcgccgcttccgccgccatctccgcgtttgtggggcgggaaagagggagggggctagcggctgcagctggagcgggcttctctccggggacggtcctttcctccctgctctccttttccttctttccgcgttgccgccgcccgccccctgcgcctccccgcggagcctgggtccgggagggggaaggtaggggcggcggggggcgggagagtctggcgagcggacgctagctctgaggaaactcatcaatccgtgagccccggagtccggggtgcacatcggcccagccgcagcgtcggcggcggcggcggcagcagcacgaaggggctcagtcggggtaggcgggggcggtgccggtgccgcgggggcgggcccgaccgtcccgcccagaagttgtagggcttggctcctcgcgatcttgttcctttcccctccgcttctctgacctagctgcgcggccccggcccgggagctgccgaacccgcgcctcccctgggtgaggaggacacgcctgccctcgtcgagaaaacttttcctgccgactcagttggggcggcggtggcaggaagtgcgggcagcgacctctcctccgcctgccccgcgcgccctgccggaggtcggcgctgagcttgcgatcaagtttgtgggggccccccttcccagttgccggcgagtctcgcctcgagaggggcgcccgaccccggggagggcggcaggccagggcgaaggccaagggcgtgtggtggcgccggagactaggtgcggagcaaggcggggactcgcacccgcatccgagagcgcggaggtcgcgcagcccgggagaagggagcctccggcggctgcttcctagagtccacagtgcgctgtctcctttggctgaggagagtgtcctggccccgagtctatcgaggaaaatgaagttaagccgccagttcaccgtgttcggcagtgcgatcttctgtgtggtgattttctcgctctacctgatgctggaccggggtcacttagactaccccaggaacccgcgccgcgagggctccttccctcagggccagctctcaatgttgcaagaaaaaatagaccatttggagcgtttgctagctgagaataatgagatcatctcaaatattagagactcagtcatcaatttgagtgagtctgtggaggatggtccgaaaagttcacaaagcaatttcagccaaggtgctggctcacatcttctgccctcacaattatccctctcagttgacactgcagactgtctgtttgcttcacaaagtggaagtcacaattcagatgtgcagatgttggatgtttacagtctaatttcttttgacaatccagatggtggagtttggaagcaaggatttgacattacttatgaatctaatgaatgggacactgaaccccttcaagtctttgtggtgcctcattcccataacgacccaggttggttgaagactttcaatgactactttagagacaagactcagtatatttttaataacatggtcctaaagctgaaagaagactcacggaggaagtttatttggtctgagatctcttacctttcaaagtggtgggatattatagatattcagaagaaggatgctgttaaaagtttaatagaaaatggtcagcttgaaattgtgacaggtggctgggttatgcctgatgaagctactccacattattttgccttaattgatcaactaattgaaggacatcagtggctggaaaataatataggagtgaaacctcggtccggctgggctattgatccctttggacactcaccaacaatggcttatcttctaaaccgtgctggactttctcacatgcttatccagagagttcattatgcagttaaaaaacactttgcactgcataaaacattggagtttttttggagacagaattgggatctgggatctgtcacagatattttatgccacatgatgcccttctacagctatgacatccctcacacttgtggacctgatcctaaaatatgctgccagtttgattttaaacgtcttcctggaggcagatttggttgtccctggggagtccccccagaaacaatacatcctggaaatgtccaaagcagggctcggatgctactagatcagtaccgaaagaagtcaaagctttttcgtaccaaagttctcctggctccactaggagatgatttccgctactgtgaatacacggaatgggatttacagtttaagaattatcagcagctttttgattatatgaattctcagtccaagtttaaagttaagatacagtttggaactttatcagatttttttgatgcgctggataaagcagatgaaactcagagagacaagggccaatcgatgttccctgttttaagtggagattttttcacttatgccgatcgagatgatcattactggagtggctattttacatccagacccttttacaaacgaatggacagaatcatggaatctcatttaagggctgctgaaattctttactatttcgccctgagacaagctcacaaatacaagataaataaatttctctcatcatcactttacacggcactgacagaagccagaaggaatttgggactgtttcaacatcatgatgctatcacaggaactgcaaaagactgggtggttgtggattatggtaccagactttttcattcgttaatggttttggagaagataattggaaattctgcatttcttcttattttgaaggacaaactcacatacgactcttactctcctgataccttcctggagatggatttgaaacaaaaatcacaagattctctgccacaaaaaaatataataaggctgagtgcggagccaaggtaccttgtggtctataatcctttagaacaagaccgaatctcgttggtctcagtctatgtgagttccccgacagtgcaagtgttctctgcttcaggaaaacctgtggaagttcaagtcagcgcagtttgggatacagcaaatactatttcagaaacagcctatgagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaagcaaatgatgactaaagaagatggtaaacaccatgaagtaaatgtgcaattttcatggtatggaaccacaattaaaagagacaaaagtggtgcctacctcttcttacctgatggtaatgccaagccttatgtttacacaacaccgccctttgtcagagtgacacatggaaggatttattcggaagtgacttgcttttttgaccatgttactcatagagtccgactataccacatacagggaatagaaggacagtctgtggaagtttccaatattgtggacatccgaaaagtatataaccgtgagattgcaatgaaaatttcttctgatataaaaagccaaaatagattttatactgacctaaatgggtaccagattcaacctagaatgacactgagcaaattgcctcttcaagcaaatgtctatcccatgaccacaatggcctatatccaggatgccaaacatcgtttgacactgctctctgctcagtcattaggggtttcgagtttgaatagtggtcagattgaagttatcatggatcgaagactcatgcaagatgataatcgtggccttgagcaaggtatccaggataacaagattacagctaatctatttcgaatactactagaaaaaagaagtgctgttaatacggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtgggcaatgggcactccaatgaggcagccttgatcctccacagaaaagggtttgattgtcggttctctagcaaaggcacagggctgttttgttctactactcagggaaagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaa

SEQ ID NO: 151501 - DNA, 6268 bp, Homo sapiens
  Payload ID: 9828
  Gene Symbol: MAN2A2
  Gene Name: mannosidase, alpha, class 2A, member 2
  Uniprot ID: P49641
  ENST ID: ENST00000360468
  CDS Start-End: 19-3471
gtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttggggggccggggtcagaagccagagctgcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaacctaagaatcaactgaagacctgttaagagtattctgtaagtcaacccaatgatacacatcatgttcctgtccacatactggttttccccaaatcagctgataaattcagtgtaattccaatgagattgaaactttggaattgacagttctaaagtgcatttgggagagtgaatgtgtgagaacactaagaccactctgaacgatgataatgagttggggggtggactgctcgggggtgatcctgccagattcccagaggattctcacgccaccattacctcactcagtgtgacctggagggggtcagacagacgggagagtccagaaacagacccagggctacaggaatttagtatatggtaagagggatgttttaagtggggaaaaaggtggattatttaataaacagcacttttagacaactagctatcaaagctagatctcagctgggtgcgatggctcacgcctgtaatcccggcactttgggaggccaaggtgggtggatcacttgaggtcaggagttcgagaccagcctggccaagatggcgaaaccctgtgtctactaaaaatacaaaaactagccaggaatggtggcgcgcgcctgtaatcccagttacttaggaggctgaggcaggagaatcacatcaacctgggaggcggaggttgcagtgagcttagatcatgccaccatgccactgcactccagcctgggtgacacagccaaaaaaaaaaccactaagttagatctctacctcacagtgtccatacaaattagttccagagggaagatataccacaaaattactcaaaaatttttatacctctggtgtgggacggtcttttctaaactttaacatgagacttaaaagatataataagggaaaagataagcagatttcgcaaccaaaaaatatcgaaagtctctgtgtgatggaaaacatcaaggttaaaacacaaatgacagatatggaagaaaatatttgcagcacataaaaaaatcaacgagtacaattactttaggagaaaagcttgcttcagggtccttagagaaagtcactggggcctgccaagctgccacctaaagacaagagtgagagggctgagttcttccaggtcatcagagttgttgctgcccgtattaggccacacagtggaaccccatttatatcatagcagaagaaataggattatcaatgtgaactgcttagcatggtgcctggtatatacgagagctccacaaatgtgagctataatcctactagtaaaggatgctaagcagttccactgtggcaggtgtcatttgctagtagaatttgtaatcaaacaataggaggggaatctgtgaacgcctagaaaatgagcagaataaaggatattatctttggaagtctt

SEQ ID NO: 151502 - DNA, 4918 bp, Homo sapiens
  Payload ID: 9828
  Gene Symbol: MAN2A2
  Gene Name: mannosidase, alpha, class 2A, member 2
  ENST ID: ENST00000558161
  CDS Start-End: 69-2459
ggcagctcggccgactgggcccggagcggcgcggaggccgggcgctgacggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttggggggccggggtcagaagccagagctgcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaaggggtcagggctgtgttttttggcagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaa

SEQ ID NO: 151503 - DNA, 624 bp, Homo sapiens
  Payload ID: 9828
  Gene Symbol: MAN2A2
  Gene Name: mannosidase, alpha, class 2A, member 2
  ENST ID: ENST00000558853
  CDS Start-End: 473-624
aaacagccaagaaaagtctgtgtcttgttcactcgctggcaggaaacatagagcaggcacggaaaggaaagggactcgaggaatgcgctgtaccgacaggaggcagcacccctttgcccgaggggcgcaacgacagagacctaaggctacctgggccggagccgggtgaggccgcggagaacgcaccccgctacgcgtctgccgagacggaggcgggcgtttcgaccactgcccgatcatgcgcttactcaactccacccacattggcctagacccagtctctaagggctgaaaatattgcccggaagctcccgagcagaatcagatcgcgctaagtagggcacaacgcagaggcgacaaagctcctcggccccagggcccgcggagcagactccggagcgcggtcccgcccacgctcggctccgcagttagcgtcctccttcctcctgagcaggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgca

SEQ ID NO: 151504 - DNA, 1443 bp, Homo sapiens
  Payload ID: 9828
  Gene Symbol: MAN2A2
  Gene Name: mannosidase, alpha, class 2A, member 2
  ENST ID: ENST00000561448
  CDS Start-End: 1-1081
gtttcctctccgtgtcattgactctggcaccagcgacttcgccctcagcaaccgctacatgcaggtctggttctcaggccttactgggctcctcaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacggggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctg

SEQ ID NO: 151505 - DNA, 988 bp, Homo sapiens
  Payload ID: 9828
  Gene Symbol: MAN2A2
  Gene Name: mannosidase, alpha, class 2A, member 2
  ENST ID: ENST00000560616
  CDS Start-End: 1-988
tcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcac

SEQ ID NO: 151506 - DNA, 583 bp, Homo sapiens
  Payload ID: 9828
  Gene Symbol: MAN2A2
  Gene Name: mannosidase, alpha, class 2A, member 2
  ENST ID: ENST00000559132
  CDS Start-End: 1-583
catgctgccctactacacggtcaatggctcctgggtggtgccaccggagccccggcccagcttcttctccatctccccgcaggactgccagtttgctttggggggccggggtcagaagccagagctgcagatgctcactgtgtcggaggagctgccgtttgacaacgtggatggtggtgtgtggaggcaaggcttcgacatctcctacgacccgcacgactgggatgctgaagacctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatc

SEQ ID NO: 151507 - DNA, 790 bp, Homo sapiens
  Payload ID: 9828
  Gene Symbol: MAN2A2
  Gene Name: mannosidase, alpha, class 2A, member 2
  ENST ID: ENST00000558171
  CDS Start-End: 1-790
ggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccagcccaccttctacgcacaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctac

SEQ ID NO: 151508 - DNA, 6704 bp, Homo sapiens
  Payload ID: 9828
  Gene Symbol: MAN2A2
  Gene Name: mannosidase, alpha, class 2A, member 2
  Uniprot ID: P49641
  ENST ID: ENST00000559717
  CDS Start-End: 460-3912
gcgcgcgggagggctccggctgccccgacagaggccgggctcgggcggcgggagtgcgagcgccactgcggcgtcagaggggccaggaagggacaggaggctgcctgaggcccgtacctggcgcctgtctctgcggtccccggggccgacgaagtcggagcgggtggggagggagccgggcgggcggccagagacctggcggcaggtgcctgccctctgtgatccaactctctccccagctccacccacattggcctagacccagtctctaagggctgaaaatattgcccggaagctcccgagcagaatcagatcgcgctaagtagggcacaacgcagaggcgacaaagctcctcggccccagggcccgcggagcagactccggagcgcggtcccgcccacgctcggctccgcagttagcgtcctccttcctcctgagcaggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttggggggccggggtcagaagccagagctgcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaacctaagaatcaactgaagacctgttaagagtattctgtaagtcaacccaatgatacacatcatgttcctgtccacatactggttttccccaaatcagctgataaattcagtgtaattccaatgagattgaaactttggaattgacagttctaaagtgcatttgggagagtgaatgtgtgagaacactaagaccactctgaacgatgataatgagttggggggtggactgctcgggggtgatcctgccagattcccagaggattctcacgccaccattacctcactcagtgtgacctggagggggtcagacagacgggagagtccagaaacagacccagggctacaggaatttagtatatggtaagagggatgttttaagtggggaaaaaggtggattatttaataaacagcacttttagacaactagctatcaaagctagatctcagctgggtgcgatggctcacgcctgtaatcccggcactttgggaggccaaggtgggtggatcacttgaggtcaggagttcgagaccagcctggccaagatggcgaaaccctgtgtctactaaaaatacaaaaactagccaggaatggtggcgcgcgcctgtaatcccagttacttaggaggctgaggcaggagaatcacatcaacctgggaggcggaggttgcagtgagcttagatcatgccaccatgccactgcactccagcctgggtgacacagccaaaaaaaaaaccactaagttagatctctacctcacagtgtccatacaaattagttccagagggaagatataccacaaaattactcaaaaatttttatacctctggtgtgggacggtcttttctaaactttaacatgagacttaaaagatataataagggaaaagataagcagatttcgcaaccaaaaaatatcgaaagtctctgtgtgatggaaaacatcaaggttaaaacacaaatgacagatatggaagaaaatatttgcagcacataaaaaaatcaacgagtacaattactttaggagaaaagcttgcttcagggtccttagagaaagtcactggggcctgccaagctgccacctaaagacaagagtgagagggctgagttcttccaggtcatcagagttgttgctgcccgtattaggccacacagtggaaccccatttatatcatagcagaagaaataggattatcaatgtgaactgcttagcatggtgcctggtatatacgagagctccacaaatgtgagctataatcctactagtaaaggatgctaagcagttccactgtggcaggtgtcatttgctagtagaatttgtaatcaaacaataggaggggaatctgtgaacgcctagaaaatgagcagaataaaggatattatctttggaa

SEQ ID NO: 151509 - DNA, 529 bp, Homo sapiens
  Payload ID: 9828
  Gene Symbol: MAN2A2
  Gene Name: mannosidase, alpha, class 2A, member 2
  ENST ID: ENST00000559999
  CDS Start-End: 169-529
gcagcacccctttgcccgaggggcgcaacgacagagacctaaggctacctgggccggagccgggtgaggccgcggagaacgcaccccgctacgcgtctgccgagacggaggcgggcgtttcgaccactgcccgatcatgcgcttactcaagtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttgg

SEQ ID NO: 151510 - DNA, 2671 bp, Homo sapiens
  Payload ID: 9828
  Gene Symbol: MAN2A2
  Gene Name: mannosidase, alpha, class 2A, member 2
  ENST ID: ENST00000557865
  CDS Start-End: 1-2382
tatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactggg

SEQ ID NO: 151511 - DNA, 492 bp, Homo sapiens
  Payload ID: 9828
  Gene Symbol: MAN2A2
  Gene Name: mannosidase, alpha, class 2A, member 2
  ENST ID: ENST00000560147
  CDS Start-End: 1-492
tacgtccccaaggagccccccgtgctgcgtgtcactgaaggccctttcttctcagaggtggttgcgtactatgagcacattcaccaggcggtccggctttacaatctgccaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagct

SEQ ID NO: 151512 - DNA, 956 bp, Homo sapiens
  Payload ID: 9828
  Gene Symbol: MAN2A2
  Gene Name: mannosidase, alpha, class 2A, member 2
  ENST ID: ENST00000557990
  CDS Start-End: 1-956
caaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgagcctgactttttctccaaactggcagccatgtttaggggcttgatctttcacagcagcaggagcggtaaccgagaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttga

SEQ ID NO: 151513 - DNA, 449 bp, Homo sapiens
  Payload ID: 9828
  Gene Symbol: MAN2A2
  Gene Name: mannosidase, alpha, class 2A, member 2
  ENST ID: ENST00000559704
  CDS Start-End: 1-175
ctgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacggaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaacct

SEQ ID NO: 151514 - DNA, 1049 bp, Homo sapiens
  Payload ID: 9828
  Gene Symbol: MAN2A2
  Gene Name: mannosidase, alpha, class 2A, member 2
  ENST ID: ENST00000558290
  CDS Start-End: 832-1049
attgcagtatggattacactgaaaaactgtaaacaacctagatgcccagtaaaagggaaacagccaagaaaagtctgtgtcttgttcactcgctggcaggaaacatagagcaggcacggaaaggaaagggactcgaggaatgcgctgtaccgacaggaggcagcacccctttgcccgaggggcgcaacgacagagacctaaggctacctgggccggagccgggtgaggccgcggagaacgcaccccgctacgcgtctgccgagacggaggcgggcgtttcgaccactgcccgatcatgcgcttactcaactccacccacattggcctagacccagtctctaagggctgaaaatattgcccggaagctcccgagcagaatcagatcgcgctaagtagggcacaacgcagaggcgacaaagctcctcggccccagggcccgcggagcagactccggagcgcggtcccgcccacgctcggctccgcagttagcgtcctccttcctcctgagcaggcaagcggagcccgagggcggtggcggcggggggcacgggtcccctgaagttgcctcgcagctgagcactgggccccgtctctcccttcccagggggccttcggcgtcactgcaggcttcctaggggtcccctaagtgctctgcaaaccgcggctggaagtttcccactgcagtgaacagtagagaaacagggagaacacacagggcttgctttatgctagaaacacaagcatctttcttctttattagaaagaaactcattctgtgtttctgagaaaggatcgtgccaggcactgtttctggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaagga

SEQ ID NO: 151515 - DNA, 537 bp, Homo sapiens
  Payload ID: 9828
  Gene Symbol: MAN2A2
  Gene Name: mannosidase, alpha, class 2A, member 2
  ENST ID: ENST00000559965
  CDS Start-End: 310-537
agtttgacccgaaagggcactgagaaaggctttcctatcagtctctttgggttctggctaaacttttaaatcaaacaaaatagagactagcttattcacctgaaactagaagcacatggccgaggagcctgaacaggcacctcctatctaggcagggaagctgtgtaatcaggagcttgtgtggtgcgctccagtcggagctgggactcttatcctgggcccgtttttcatagcaccagccaaaggagagcgtcctctccaccctagcggcagagctgctaccaggaccaggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctg

SEQ ID NO: 151516 - DNA, 5124 bp, Homo sapiens
  Payload ID: 9828
  Gene Symbol: MAN2A2
  Gene Name: mannosidase, alpha, class 2A, member 2
  ENST ID: ENST00000560451
  CDS Start-End: 300-3116
caggccggggcgggcggcgcggctgtccccgccccgcacgctgctgggcccggcagcttcagaggctggcggacccgcgcggggccggcgcagcggagcgcgccggcggcccggggcccagcgggagcgcggcagcggcgcgcggagcagggggctacgggtgggcgggcgcccgccttcgcctgcgtcgctgcctgcacgcgggccgccgtccccgggcgtgtgagagccggcagctcggccgactgggcccggagcggcgcggaggccgggcgctgacggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttggggggccggggtcagaagccagagctgcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaa

SEQ ID NO: 151517 - DNA, 3170 bp, Homo sapiens
  Payload ID: 9829
  Gene Symbol: MAN2B1
  Gene Name: mannosidase, alpha, class 2B, member 1
  Uniprot ID: O00754
  ENST ID: ENST00000221363
  CDS Start-End: 34-3066
ggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaaga

SEQ ID NO: 151518 - DNA, 3184 bp, Homo sapiens
  Payload ID: 9829
  Gene Symbol: MAN2B1
  Gene Name: mannosidase, alpha, class 2B, member 1
  Uniprot ID: O00754
  ENST ID: ENST00000456935
  CDS Start-End: 42-3077
ctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactc

SEQ ID NO: 151519 - DNA, 340 bp, Homo sapiens
  Payload ID: 9829
  Gene Symbol: MAN2B1
  Gene Name: mannosidase, alpha, class 2B, member 1
  ENST ID: ENST00000596591
  CDS Start-End: 1-203
ccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccg

SEQ ID NO: 151520 - DNA, 535 bp, Homo sapiens
  Payload ID: 9829
  Gene Symbol: MAN2B1
  Gene Name: mannosidase, alpha, class 2B, member 1
  ENST ID: ENST00000486847
  CDS Start-End: 42-535
ctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagtcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgcc

SEQ ID NO: 151521 - DNA, 551 bp, Homo sapiens
  Payload ID: 9829
  Gene Symbol: MAN2B1
  Gene Name: mannosidase, alpha, class 2B, member 1
  ENST ID: ENST00000598876
  CDS Start-End: 36-551
agggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgaggtatgtgtgtttggggtccctgtgcagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacc

SEQ ID NO: 151522 - DNA, 537 bp, Homo sapiens
  Payload ID: 9829
  Gene Symbol: MAN2B1
  Gene Name: mannosidase, alpha, class 2B, member 1
  ENST ID: ENST00000593686
  CDS Start-End: 1-422
agcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtata

SEQ ID NO: 151523 - DNA, 5143 bp, Homo sapiens
  Payload ID: 9830
  Gene Symbol: MAN2B2
  Gene Name: mannosidase, alpha, class 2B, member 2
  Uniprot ID: Q9Y2E5
  ENST ID: ENST00000285599
  CDS Start-End: 37-3066
gaagtgggcctggcaccttcccggcctgccgcagggatggggcagctgtgctggctgccgctgctggcaccgctcctgttgctgcgaccgccaggggtccagtccgccggccccatccgggccttcgtggtgccccacagccacatggacgtgggctgggtctacactgtgcaggaaagcatgcgggcgtacgccgccaatgtctacacctcagtggtggaagagctggcccgcggccagcagcgccggttcatcgctgtggagcaggagtttttccggctgtggtgggatggcgtcgcctcggaccagcagaaataccaggtccgccagctcctggaggaaggacgcctggaatttgtcatcggaggccaggtcatgcatgacgaggctgtgacgcaccttgatgaccagatcctgcagctcacagaaggacacgggtttctctatgaaacatttgggatccggccacagttctcctggcacgttgacccgtttggcgcctctgccacgacgcccaccctatttgcgctggcgggcttcaatgcccacctcggctcccggatcgactacgacctgaaggcagccatgcaggaggcccgggggctgcagttcgtgtggcgagggtccccatccctctcagagcggcaggaaatcttcacgcacatcatggaccagtacagctactgcaccccgtcccacatccctttctccaacaggtcaggattttactggaatggcgtggctgtcttccccaagcctccccaagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctatatgaagtgggcgaggacccagtcctgtctcagccagtgacagtgaatctggaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtgagccctgggcagatgccccggccccagggcttcccccaggaactccatgtaacagaacagacccaggacagggaaaagcagtgcggagggatgggactggggagtcagctgctcatctgcaggctaatggcaggaaatggtcatatttggggtttttccctaatttttttaaacaaaaattacattacaagatccaggttcttcccccccacactcaatcaagccagccctctcctcttctgtcacgtaaaggatatttggcacactcatgcgtcattcattcacaaaacacaaacccaggactttctgcctaaggcagagcacaagactcacagcagcaccgaagcgcatctgccgtccgggccctgccaggcttgccaggctgccagtggtaactgtggacctactgcgtgccacgtgttttcatagactcatcccatgctggcaacagccctgcaaggggcttggctctgccacagggcaggagaggaagttgtagcgcctagcgagagttccagccccagacgcccacctgtgcctcagggcaccgcctgccgagcagagaaggcacagcagccgtcagagtccatgagaggtgaaaccacacagcagggatgtccaatatcagaactattaatatcaataaaagtataaccttcccaggtctatgcccaagagaattgaaaacatccatccacacaatacctgtgctcccgcgttcatagcagcattactcaaaagtcaaacggtagcaacaacccaaatgtccatccacagatgaattaagacatgaagtgtgttctgtccatacaatggaatattatttggccataaaaaggaaggaaattctgacgcatgccacagcctgagtgaatcctacaaatattacgctaagtgaaagaagccaatcacgagtttatgtgaaatgtccagaataggcaaatctgtgtatcagagacaaagcacattggtggttgccaggtactggaggaagagagaagaggcatgacagctaacagggacgggctttctttggaagatgatgaaattgtggaatgatggttgcacaactttgtgaatatactagaaaccaatgaattaaaaactttggaagatgaattttatggtctgtgaattatatctcaattttaaaacttttttttttttttcccgagacagagtctcactctgtcgcccaggctggagtgcagtgtcaagatctcagctcactgcgacctgcacctcctgggttcaagcaattctccagcctctgcctcccgagtagctgctactagagatgcaccactgcgtcagctaatttttgtatttttagtagagacggggattcaccatgttggccaggctgatctggaactcctgacctcaggtgatctgcctgccccggcctcccaaagtgccaggattacaggcgtgagccaatgtgcccggcctaaaccgttttaaagagtaaactgtaagatgtaggaaattatttggtactctagggctgaaggaaagtacccagaaaggaccagcttggaaggagtcagacctctggacaacgtgcagtttggccaccagacagcaaagacagtctctggtttggccaggcaggagctgggctggagttgctgaccaagcaataggccacccctgtgaggtggggtcaggtgagcagccaccagaggcatggatgtgcagtgggaggttgaggcacaaggagtgaggcaggagccctttagagcatgtgggctgcatgaggcttggtttctgtgtcaagaagactatggaggctgggcagtggttcatgccttaatcccagcactttgggaggccaaagcaaccggatcactggtggtcagtagttcaagaccaggctggccaacatggtgaaaccccatctctactaaaaatacaaagttaaccgggtgtggtggtgtgcgcctgtagtcccagctactcgggaggctgaggcaggagaatcaatcacttgaacctgggaggcggaggagacctccgcctctgcactccagcctgggtgacaagagtgagactccgtctcaaaaaaaaaaaaaaaa

SEQ ID NO: 151524 - DNA, 2968 bp, Homo sapiens
  Payload ID: 9830
  Gene Symbol: MAN2B2
  Gene Name: mannosidase, alpha, class 2B, member 2
  ENST ID: ENST00000504248
  CDS Start-End: 23-2899
accttcccggcctgccgcagggatggggcagctgtgctggctgccgctgctggcaccgctcctgttgctgcgaccgccaggggtccagtccgccggccccatccgggccttcgtggtgccccacagccacatggacgtgggctgggtctacactgtgcaggaaagcatgcgggcgtacgccgccaatgtctacacctcagtggtggaagagctggcccgcggccagcagcgccggttcatcgctgtggagcaggagtttttccggctgtggtgggatggcgtcgcctcggaccagcagaaataccaggtccgccagctcctggaggaaggacgcctggaatttgtcatcggaggccaggtcatgcatgacgaggctgtgacgcaccttgatgaccagatcctgcagctcacagaaggacacgggtttctctatgaaacatttgggatccggccacagttctcctggcacgttgacccgtttggcgcctctgccacgacgcccaccctatttgcgctggcgggcttcaatgcccacctcggctcccggatcgactacgacctgaaggcagccatgcaggaggcccgggggctgcagttcgtgtggcgagggtccccatccctctcagagcggcaggaaatcttcacgcacatcatggaccagtacagctactgcaccccgtcccacatccctttctccaacaggtcaggattttactggaatggcgtggctgtcttccccaagcctccccaagatggggtgtaccccaacatgagtgagcctgtcaccccagccaacatcaacctctatgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctatatgaagtgggcgaggacccagtcctgtctcagccagtgacagtgaatctggaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtgagccctgggcagatgccccggccccagggcttcccccaggaactccatgtaacagaacagacccaggaca

SEQ ID NO: 151525 - DNA, 7719 bp, Homo sapiens
  Payload ID: 9830
  Gene Symbol: MAN2B2
  Gene Name: mannosidase, alpha, class 2B, member 2
  ENST ID: ENST00000505907
  CDS Start-End: 1-2861
ggcagctgtgctggctgccgctgctggcaccgctcctgttgctgcgaccgccaggggtccagtccgccggccccatccgggccttcgtggtgccccacagccacatggacgtgggctgggtctacactgtgcaggaaagcatgcgggcgtacgccgccaatgtctacacctcagtggtggaagagctggcccgcggccagcagcgccggttcatcgctgtggagcaggagtttttccggctgtggtgggatggcgtcgcctcggaccagcagaaataccaggtccgccagctcctggaggaaggacgcctggaatttgtcatcggaggccaggtcatgcatgacgaggctgtgacgcaccttgatgaccagatcctgcagctcacagaaggacacgggtttctctatgaaacatttgggatccggccacagttctcctggcacgttgacccgtttggcgcctctgccacgacgcccaccctatttgcgctggcgggcttcaatgcccacctcggctcccggatcgactacgacctgaaggcagccatgcaggaggcccgggggctgcagttcgtgtggcgagggtccccatccctctcagagcggcaggaaatcttcacgcacatcatggaccagtacagctactgcaccccgtcccacatccctttctccaacaggtcaggattttactggaatggcgtggctgtcttccccaagcctccccaagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctatatgaagtgggcgaggacccagtcctgtctcagccagtgacagtgaatctggaggtgaacttccccacccccatccagaccataagccagggaagcaaaccctagatgaagccccaagaaactgccttggcaaagagatccacgagggcttcctcccaaatggacgctggtatgggccccaccccgcccttcttcatggtcttctgggtttgtcaggtattacaactggcctggttttttagggttttttgtgtatatgtgagacaggatctcactctgttgcccagtctggggtgcagtggcacaatctcagctcactgcaacctctgcctccctggctcaagtgatcctcccacctcaacctcccaagtaactgggatcacaggggcgcgccaccacgatggctaagtttttttttttttttttgagaccgagtttcgctctcgtcccccaggctggagtgcaatggtgcgctctcagctggctgcaacctccatctcccaggttcaagtgattctcctgcctcagcctcccgagtagctgggattacaggcatgtgccaccacgcccggctaatttttttgtacttttagtagagacagggtttctccatgttggtcaggctggtcacgaacccctgacttcaggtgatccacctgcctcggcctcgcaaagtgctgggattacaggcgtgagccaccaagcctggcctagtttttttatttttagtagagacacggtcttgctgtgttgctcaggctggtctcgaacgtctggcctcaagcaatctgcctgtcttagcctcctgaagtgctgggattacaggcgtgagtggcctgtattttctttcttatttattctgtggtaaaacttttaaaacacagacaacatctgtgtaatccaaaaacaaaacagattccccatagagttgctttgaaaggtgacttagagtcagacaatccagggtccacacccaggcccctctacgggggcatctccggcaccccatgcctctgggcctcagtttccccccatgtaaaatggggagaggtgagagttctttgcccagaaggttgctgagaggccctggcactaaggggcctcgtgcagtgtcagggcccccaggcctcgtccccttccaggttcccctcttggctgatgttgccctctcagctctactatcaggcgaggcttccgccacctggcctgcccacgctccctccccagaaggcatgacctgagccgcctcatttctttcccagtttgcattctttctatttcatttcctgctcatggagaatttctgtgaatctctgtgtttctgccttgggcctccttcgacatctgagtcttcaggggaatccagagaagccccagtaccttttcgccatgatgtcttactgggccacccacctcctctttcatgatcctcgccacggaggatcctttcctcacggtccctggcctgcctgagagcaggtctaggccatggcgggtaccagtgcccagcacagggccagcctgccctgggaagcaaggaggccagcgtgggacctggaagttggtcatctgatgctcccccgtttcacagatggaagcaccaaggccctgagacaaggagacggttgggatggacaccatgactccctgcccaacgtggacggtggtggggtggaaagaccattgagttaggaacgcagtgagtttggctgcaagtcacaaaacacctaacagatgtgcttagaacagaggacagagtgttttctcaccgaacaggcatgtccgatggaccccaagcgctgtcaccgtgggcccgatcactgtcatcttcccgccatcgccggcagactggcttttgtcttttgccgtctgcttgtttgcggtcacaagatggcacaggcctccctcatgagcaaatttcaaggcagggtagggctcagcagtagtggccagaaaggccttgccctagcgtggctctctccctccgtcagcacacagaagcttctccaagagccacccccagccctcctgctccacagacttttccagacccctaagggcctcctgcctcccctaggtgtaagggaggctgggacaaggcctattgggaaagggggatggggtaactgtggctggcttcctccctggactgggcacggggccacctgagcaatgtggggagaggagaactccgcggtggggtgggcagctcaaaatgccacacctcccgggctgctcctccagctcggccacctggtaaagcatgcacctcccgcttcagtgtcctcatctgtaaagtacacggccagtcctgtcctcgcagatgtgctgtgagaagcagatgagggagctgtgtcaggcaccaggggaggacctgggctcctgaggacaccgagttcgtggtgtgtctgccctgctgctgtcttggttctctgctcagctctggaacttggtgcagctcactctccctctgctcctctccctgcaggctgtgctgcaggcgctggggtccgtggtggcagtggaggagcgctcgctcacagggacctgggatttgagcatgctgcaccgctggagctggaggacggggcctggccgccacagaggtttggggacccccgcttcagctccctacccaggactcccagccaggctcagcagctggtcagacccggtgcacatccaaccatctgcctgtcccggcctgtgcgaccttgcgaggctgctttcctactctgaacccgcagccctcccaaatctactacagtcggttaagaaaggctttgggttagtctctgcctgccagggctccacacaggcgtgtgtgtgcacttgtacgtgtgcacacgcagaccacacgccctgcctgtgccctgggtgacagctaggggcccaggggcttctgcccaccttggccctgctgacctcagcccatcagccggtccctgcctcatacgacatgtgccaccgtgagctcctgcactacaggcagcttccaggctccactccctgtccgcaccatgccctctgcctgggacgcacaggtcccattcactctggccagcacctgctcaagctccccaggatgcctccccagagtcaccaaccaggccaagtgcctcctccactctcctggccccaggggtttcttctgtcctgtgcagctcgttgtccactacacacagcatggtggcgggtgcatggtgcacgctcagttggtggtgggaggaaggaagggacggagggagggagggagggaagatgatgttggttggaaagaaggaaggaagatggatgagtgatagataagtggacggctccctcccaagatcgaagcccaaccccagggcatgccttcaggggagcctggtgaggcaagggcagactcaccagatggtctcagaaagctcttgggctttgagggcaacacccatgaggaattgaggccactagggccaggaccaacctatgaattgccctcagggtgggcagaaacgccaagaggcccacaggagtcctggcagaaggggatgccataggccgttgccacggtgggagccacagcagactgtagccaggtgcagtgtggtgagaaggaggctgggagccacagcagattgtagacaggtgcaggagggtgagagggaggctgggagccacagcagactgtagacaggtgcagggggtgagagggaggctgggaggaggcatcccaggccacactggacagatcacctctgttcccctaggtgacaccacctctccctcgaggccaccaggaggccccatcatcaccgtccacccaaaggaaatccggacgttctttattcactttcaacagcagtgagccctgggcagatgccccggccccagggcttcccccaggaactccatgtaacagaacagacccaggacagggaaaagcagtgcggagggatgggactggggagtcagctgctcatctgcaggctaatggcaggaaatggtcatatttggggtttttccctaatttttttaaacaaaaattacattacaagatccaggttcttcccccccacactcaatcaagccagccctctcctcttctgtcacgtaaaggatatttggcacactcatgcgtcattcattcacaaaacacaaacccaggactttctgcctaaggcagagcacaagactcacagcagcaccgaagcgcatctgccgtccgggccctgccaggcttgccaggctgccagtggtaactgtggacctactgcgtgccacgtgttttcatagactcatcccatgctggcaacagccctgcaaggggcttggctctgccacagggcaggagaggaagttgtagcgcctagcgagagttccagccccagacgcccacctgtgcctcagggcaccgcctgccgagcagagaaggcacagcagccgtcagagtccatgagaggtgaaaccacacagcagggatgtccaatatcagaactattaatatcaataaaagtataaccttcccaggtctatgcccaagagaattgaaaacatccatccacacaatacctgtgctcccgcgttcatagcagcattactcaaaagtcaaacggtagcaacaacccaaatgtccatccacagatgaattaagacatgaagtgtgttctgtccatacaatggaatattatttggccataaaaaggaaggaaattctgacgcatgccacagcctgagtgaatcctacaaatattacgctaagtgaaagaagccaatcacgagtttatgtgaaatgtccagaataggcaaatctgtgtatcagagacaaagcacattggtggttgccaggtactggaggaagagagaagaggcatgacagctaacagggacgggctttctttggaagatgatgaaattgtggaatgatggttgcacaactttgtgaatatactagaaaccaatgaattaaaaactttggaagatg

SEQ ID NO: 151526 - DNA, 3284 bp, Homo sapiens
  Payload ID: 9831
  Gene Symbol: MAN2C1
  Gene Name: mannosidase, alpha, class 2C, member 1
  Uniprot ID: Q9NTJ4
  ENST ID: ENST00000267978
  CDS Start-End: 48-3170
aacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 151527 - DNA, 1111 bp, Homo sapiens
  Payload ID: 9831
  Gene Symbol: MAN2C1
  Gene Name: mannosidase, alpha, class 2C, member 1
  ENST ID: ENST00000421803
  CDS Start-End: 23-652
aaagaggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctg

SEQ ID NO: 151528 - DNA, 867 bp, Homo sapiens
  Payload ID: 9831
  Gene Symbol: MAN2C1
  Gene Name: mannosidase, alpha, class 2C, member 1
  ENST ID: ENST00000569355
  CDS Start-End: 27-569
ccggaaagaggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaaggctggagtgcaatggcacgatctcggctcactgcgaccgccgcctcccaggttcaagcaattctcctgcctcagcctccctactagctgagattacagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtga

SEQ ID NO: 151529 - DNA, 2961 bp, Homo sapiens
  Payload ID: 9831
  Gene Symbol: MAN2C1
  Gene Name: mannosidase, alpha, class 2C, member 1
  Uniprot ID: Q9NTJ4
  ENST ID: ENST00000563622
  CDS Start-End: 22-2847
aagaggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 151530 - DNA, 580 bp, Homo sapiens
  Payload ID: 9831
  Gene Symbol: MAN2C1
  Gene Name: mannosidase, alpha, class 2C, member 1
  ENST ID: ENST00000566256
  CDS Start-End: 30-580
cttccggaaagaggagcgagagcccggcgatggcggctgcgccggccttgaagcactggcgcaccacgctggagcgggtggagaagttcgtgtcgccgctctactttaccgactgtaacctccgcggcagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctggg

SEQ ID NO: 151531 - DNA, 602 bp, Homo sapiens
  Payload ID: 9831
  Gene Symbol: MAN2C1
  Gene Name: mannosidase, alpha, class 2C, member 1
  ENST ID: ENST00000562071
  CDS Start-End: 30-299
cttccggaaagaggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacctctcttgcagatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgc

SEQ ID NO: 151532 - DNA, 3177 bp, Homo sapiens
  Payload ID: 9831
  Gene Symbol: MAN2C1
  Gene Name: mannosidase, alpha, class 2C, member 1
  Uniprot ID: Q9NTJ4
  ENST ID: ENST00000569482
  CDS Start-End: 10-3063
agcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaaggcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 151533 - DNA, 569 bp, Homo sapiens
  Payload ID: 9831
  Gene Symbol: MAN2C1
  Gene Name: mannosidase, alpha, class 2C, member 1
  ENST ID: ENST00000568374
  CDS Start-End: 23-569
aaagaggagcgagagcccggcgatggcggctgcgccggccttgaagcactggcgcaccacgctggagcgggtggagaagttcgtgtcgccgctctactttaccgactgtaacctccgcggcagatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgacc

SEQ ID NO: 151534 - DNA, 571 bp, Homo sapiens
  Payload ID: 9831
  Gene Symbol: MAN2C1
  Gene Name: mannosidase, alpha, class 2C, member 1
  ENST ID: ENST00000565784
  CDS Start-End: 23-256
aaagaggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagt

SEQ ID NO: 151535 - DNA, 992 bp, Homo sapiens
  Payload ID: 9831
  Gene Symbol: MAN2C1
  Gene Name: mannosidase, alpha, class 2C, member 1
  ENST ID: ENST00000570257
  CDS Start-End: 1-519
ggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagctcctgaaggtattgattctgatgcagccgaagttttgggatcacagaacaagggctttctctgctgtgccaagatgtaggcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatgggattgggttggcctgagcgcctgcctgctccccgtccagcgctgacctgggctgcctcccacttccttcactgccaggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcaccca

SEQ ID NO: 151536 - DNA, 1540 bp, Homo sapiens
  Payload ID: 9831
  Gene Symbol: MAN2C1
  Gene Name: mannosidase, alpha, class 2C, member 1
  ENST ID: ENST00000566634
  CDS Start-End: 23-256
aaagaggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcc

SEQ ID NO: 151537 - DNA, 3300 bp, Homo sapiens
  Payload ID: 9831
  Gene Symbol: MAN2C1
  Gene Name: mannosidase, alpha, class 2C, member 1
  Uniprot ID: Q9NTJ4
  ENST ID: ENST00000565683
  CDS Start-End: 13-3186
gagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctaggcctcacccccagccctggtgacagtgcccagcatgggctatgctcctgttcctccccccacctcactgcagcccctgctgccccagcagcctgtgttcgtagtgcaagagcccctacagactcagcctcaaggcctcctcccacaaagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 151538 - DNA, 568 bp, Homo sapiens
  Payload ID: 9831
  Gene Symbol: MAN2C1
  Gene Name: mannosidase, alpha, class 2C, member 1
  ENST ID: ENST00000561615
  CDS Start-End: 21-568
agaggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaaggttcaagcgattctcatgcctcagcttcccgagtagcagggattacagcctcactctctatgtggaagtagcctgcaatgggctcctgggggccgggaagggaagcatgattgcagcccctgaccc

SEQ ID NO: 151539 - DNA, 1346 bp, Homo sapiens
  Payload ID: 9831
  Gene Symbol: MAN2C1
  Gene Name: mannosidase, alpha, class 2C, member 1
  ENST ID: ENST00000618257
  CDS Start-End: 25-1302
ctgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacctcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcggg

SEQ ID NO: 151540 - DNA, 2904 bp, Homo sapiens
  Payload ID: 9832
  Gene Symbol: MANBA
  Gene Name: mannosidase, beta A, lysosomal
  Uniprot ID: O00462
  ENST ID: ENST00000226578
  CDS Start-End: 101-2740
aaagcctcggctacttccgagggggtgagtggcttcaccgccggtcccttgcagcgctgcctttcgatctctccacatctcggtggcgcgggatctcaagatgcgcctccacctgctcctgctgctcgcgctgtgcggtgcaggcaccaccgccgcggagctcagttacagcttgcgtggcaactggagcatctgcaatgggaacggctcgctggagctgcccggggcggtccctggctgcgtgcacagcgccttgttccagcagggcctgatccaggattcttactacagatttaatgaccttaactacagatgggtctctttggataactggacctatagcaaagaatttaaaatcccctttgaaattagcaaatggcaaaaagtaaatttgattcttgagggagtggatacggtttcaaaaatcctgttcaatgaagtcactattggggaaacagacaatatgttcaatagatatagctttgatattaccaacgtggtcagggacgtgaactccattgagctgcgtttccagtcagcggtgttgtatgcagcacagcagagcaaagctcacactcgctaccaggttcccccagactgccctccacttgtgcagaagggtgaatgccatgtcaactttgttcggaaggagcaatgttcctttagttgggactgggggccttcctttcctacccagggaatctggaaagatgttagaattgaagcctataatatttgtcacctgaactacttcacattttccccaatatatgataagagtgcccaggagtggaatctggaaatagagtctacatttgatgttgtcagctcaaagccagttggtggtcaagtgatcgtagccatccctaagttgcaaacacaacagacatacagcattgaacttcaacctgggaaaaggattgttgagctatttgtgaacattagcaagaatattactgtagaaacttggtggcctcatggacatggaaaccagactgggtacaacatgactgttctttttgaactggatggaggcttaaatattgaaaaatcagctaaggtttattttaggacagtggaacttatagaagagcctataaaagggtctcctggtttgagtttctatttcaaaattaatggatttcccatatttctaaaaggctcaaactggatcccagcagattcattccaggaccgagtaacctctgagttgttacggctccttttacagtctgttgtggatgctaatatgaatactcttcgggtttggggaggaggaatttatgagcaggatgaattctatgaactctgtgatgaactaggaataatggtatggcaggattttatgtttgcctgtgccctttatccaactgatcagggcttcctggattcagtgacagcagaagttgcctaccagatcaagagactgaaatctcatccttctatcatcatatggagtggcaataatgaaaatgaggaggcgctgatgatgaattggtatcatatcagtttcactgaccggccaatctacatcaaggactatgtgacactctatgtgaaaaacatcagagagctcgtactggcaggagacaagagtcgtccttttattacgtccagtcctacaaatggggctgaaactgttgcagaagcctgggtctctcaaaaccctaatagcaattattttggtgatgtacatttttatgactatatcagtgattgctggaactggaaagttttcccaaaagctcgatttgcatctgaatatggatatcagtcctggccgtccttcagtacattagaaaaggtctcgtctacagaggactggtctttcaatagcaagttttcacttcatcgacaacatcacgaaggtggtaacaaacaaatgctttatcaggctggacttcatttcaaactcccccaaagcacagatccattacgcacatttaaagataccatctaccttactcaggtgatgcaggcccagtgtgtcaaaacagaaactgaattctaccgccgtagtcgcagcgagatagtggatcagcaagggcacacgatgggggcactttattggcagttgaatgacatctggcaagctccttcctgggcttctcttgagtacggaggaaagtggaaaatgcttcattactttgctcagaatttctttgctccactgttgccagtaggctttgagaatgaaaacacgttctatatctatggtgtgtcagatcttcactcggattattcgatgacactcagtgtgagagtccatacatggagctccctggagcccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcttgtcctcaccgaaggaggccgtggggctctgcaaggcgcagatcactgccatcatctctcagcaaggtgacatatttgtttttgacctggagacctcagctgtcgctccctttgtttggttggatgtaggaagcatcccagggagatttagtgacaatggtttcctcatgactgagaagacacgaactatattattttacccttgggagcccaccagcaagaatgagttggagcaatcttttcatgtgacctccttaacagatatttactgaaggaatctaggttgtattttcagtggacaatgggaataaagcatttctaaagcaccgactggagaggaaggcaacagagacaaggagagaagccgagagacatgtctgcgtgctgccacgcatttgagcgattgctctgtgaagagttgtacactgaacacttt

SEQ ID NO: 151541 - DNA, 628 bp, Homo sapiens
  Payload ID: 9832
  Gene Symbol: MANBA
  Gene Name: mannosidase, beta A, lysosomal
  ENST ID: ENST00000511813
  CDS Start-End: 90-296
tacttccgagggggtgagtggcttcaccgccggtcccttgcagcgctgcctttcgatctctccacatctcggtggcgcgggatctcaagatgcgcctccacctgctcctgctgctcgcgctgtgcggtgcaggcaccaccgccgcggagctcagttacagcttgcgtggcaactggagcatctgcaatgggaacggctcgctggagctgcccggggcggtccctggctgcgtgcacagcgccttgttccagcagggcctgatccagagtctcactctgtcgcccaggttggagtgaagtggcatcatcttcctcactgcattctctgcctcccaggttcaagcgattctcatggtctcaccgtgttgctcaagctggtctcgatctcctgagctcaggcaatccgcccacctcggcctgtcaaagtgctgggattacaggattcttactacagatttaatgaccttaactacagatgggtctctttggataactggacctatagcaaagaatttaaaatcccctttgaaattagcaaatggcaaaaagtaaatttgattcttgagggagtggatacggtttcaaaaatcctgttcaatgaagtcactattggggaaacagacaatatg

SEQ ID NO: 151542 - DNA, 2577 bp, Homo sapiens
  Payload ID: 9832
  Gene Symbol: MANBA
  Gene Name: mannosidase, beta A, lysosomal
  ENST ID: ENST00000505239
  CDS Start-End: 40-2508
tttcgatctctccacatctcggtggcgcgggatctcaagatgcgcctccacctgctcctgctgctcgcgctgtgcggtgcaggcaccaccgccgcggagctcagttacagcttgcgtggcaactggagcatctgcaatgggaacggctcgctggagctgcccggggcggtccctggctgcgtgcacagcgccttgttccagcagggcctgatccaggattcttactacagatttaatgaccttaactacagatgggtctctttggataactggacctatagcaaagaatttaaaatcccctttgaaattagcaaatggcaaaaagtaaatttgattcttgagggagtggatacggtttcaaaaatcctgttcaatgaagtcactattggggaaacagacaatatgttcaatagatatgagcaatgttcctttagttgggactgggggccttcctttcctacccagggaatctggaaagatgttagaattgaagcctataatatttgtcacctgaactacttcacattttccccaatatatgataagagtgcccaggagtggaatctggaaatagagtctacatttgatgttgtcagctcaaagccagttggtggtcaagtgatcgtagccatccctaagttgcaaacacaacagacatacagcattgaacttcaacctgggaaaaggattgttgagctatttgtgaacattagcaagaatattactgtagaaacttggtggcctcatggacatggaaaccagactgggtacaacatgactgttctttttgaactggatggaggcttaaatattgaaaaatcagctaaggtttattttaggacagtggaacttatagaagagcctataaaagggtctcctggtttgagtttctatttcaaaattaatggatttcccatatttctaaaaggctcaaactggatcccagcagattcattccaggaccgagtaacctctgagttgttacggctccttttacagtctgttgtggatgctaatatgaatactcttcgggtttggggaggaggaatttatgagcaggatgaattctatgaactctgtgatgaactaggaataatggtatggcaggattttatgtttgcctgtgccctttatccaactgatcagggcttcctggattcagtgacagcagaagttgcctaccagatcaagagactgaaatctcatccttctatcatcatatggagtggcaataatgaaaatgaggaggcgctgatgatgaattggtatcatatcagtttcactgaccggccaatctacatcaaggactatgtgacactctatgtgaaaaacatcagagagctcgtactggcaggagacaagagtcgtccttttattacgtccagtcctacaaatggggctgaaactgttgcagaagcctgggtctctcaaaaccctaatagcaattattttggtgatgtacatttttatgactatatcagtgattgctggaactggaaagttttcccaaaagctcgatttgcatctgaatatggatatcagtcctggccgtccttcagtacattagaaaaggtctcgtctacagaggactggtctttcaatagcaagttttcacttcatcgacaacatcacgaaggtggtaacaaacaaatgctttatcaggctggacttcatttcaaactcccccaaagcacagatccattacgcacatttaaagataccatctaccttactcaggtgatgcaggcccagtgtgtcaaaacagaaactgaattctaccgccgtagtcgcagcgagatagtggatcagcaagggcacacgatgggggcactttattggcagttgaatgacatctggcaagctccttcctgggcttctcttgagtacggaggaaagtggaaaatgcttcattactttgctcagaatttctttgctccactgttgccagtaggctttgagaatgaaaacacgttctatatctatggtgtgtcagatcttcactcggattattcgatgacactcagtgtgagagtccatacatggagctccctggagcccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcttgtcctcaccgaaggaggccgtggggctctgcaaggcgcagatcactgccatcatctctcagcaaggtgacatatttgtttttgacctggagacctcagctgtcgctccctttgtttggttggatgtaggaagcatcccagggagatttagtgacaatggtttcctcatgactgagaagacacgaactatattattttacccttgggagcccaccagcaagaatgagttggagcaatcttttcatgtgacctccttaacagatatttactgaaggaatctaggttgtattttcagtggacaatgggaataaagcatttctaaagcaccgactggagaggaa

SEQ ID NO: 151543 - DNA, 1915 bp, Homo sapiens
  Payload ID: 9833
  Gene Symbol: MANBAL
  Gene Name: mannosidase, beta A, lysosomal-like
  Uniprot ID: Q9NQG1
  ENST ID: ENST00000373605
  CDS Start-End: 813-1070
tttgtcctctgcttcccaactcttgccctatctttctattgtaccactccaaatatttcttatcacaatgttgctgttagtagtaacactagtaaatctgagtatttataagctcataaagcttgttacagccttaagcaaaaagcttggggccaagggcgttttaaaaaatgcacactttatgaggtgcaactgcggagaaatgaggacgcgttcttaagctttggtattcacatggtggtggtgctggtagaggctgttacatttcttccagtgaagctgttcttgcagccgccttggaattcacttcagggccagtttatgagccaccccaagtaatctgcttggagtctgagcatcataccttgtatttgaccaaaaatggtattcctgagctcagtgccacctgattcactgcacttggaaccagatgatgttgggctctttccagaagtcaaatccttcctgggaggatgaagatctgccagctctgaggattctggctgggaagaaaaagagcctcaagctttgaaggccattcccatggtagacagagctgatgtgaaaagtggccatcctgttgccccaggcacatgaccttctgaagtgaccaggctgaaagggaagcaatactcgtgtgatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagagtcacattttcttgcttagtcatgtgtccctccttgagttgccccctccttgtgggtttacactacatttgggagtcattgtctaatgctgacaagcacaccctctcccattatttgtgcactacagatctcctcctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccagggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaa

SEQ ID NO: 151544 - DNA, 1208 bp, Homo sapiens
  Payload ID: 9833
  Gene Symbol: MANBAL
  Gene Name: mannosidase, beta A, lysosomal-like
  Uniprot ID: Q9NQG1
  ENST ID: ENST00000373606
  CDS Start-End: 106-363
cagggtcgcagggaactacttccgggggagcggcgcggcggcgcgggagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagagtcacattttcttgcttagtcatgtgtccctccttgagttgccccctccttgtgggtttacactacatttgggagtcattgtctaatgctgacaagcacaccctctcccattatttgtgcactacagatctcctcctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccagggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaa

SEQ ID NO: 151545 - DNA, 620 bp, Homo sapiens
  Payload ID: 9833
  Gene Symbol: MANBAL
  Gene Name: mannosidase, beta A, lysosomal-like
  ENST ID: ENST00000397150
  CDS Start-End: 95-265
ggaactacttccgggggagcggcgcggcggcgcgggagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggagttccatgtagaggcctgattccattccagtcaggttattgggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggc

SEQ ID NO: 151546 - DNA, 1503 bp, Homo sapiens
  Payload ID: 9833
  Gene Symbol: MANBAL
  Gene Name: mannosidase, beta A, lysosomal-like
  Uniprot ID: Q9NQG1
  ENST ID: ENST00000397151
  CDS Start-End: 401-658
agaagtcaaatccttcctgggaggatgaagatctgccagctctgaggattctggctgggaagaaaaagagcctcaagctttgaaggccattcccatggtagacagagctgatgtgaaaagtggccatcctgttgccccaggcacatgaccttctgaagtgaccaggctgaaagggaagcaatactcgtgtgatctctcaccccgtcactcagggtggcgcaatcacgactcattggctcactgcagcctagacctcccagctggagcaattctcctgcctcagccttctgagtagctgggactacagttacagaaatatgacactgaccctttgcatttacaagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagagtcacattttcttgcttagtcatgtgtccctccttgagttgccccctccttgtgggtttacactacatttgggagtcattgtctaatgctgacaagcacaccctctcccattatttgtgcactacagatctcctcctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccagggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaa

SEQ ID NO: 151547 - DNA, 1539 bp, Homo sapiens
  Payload ID: 9833
  Gene Symbol: MANBAL
  Gene Name: mannosidase, beta A, lysosomal-like
  Uniprot ID: Q9NQG1
  ENST ID: ENST00000397152
  CDS Start-End: 437-694
gggagcggcgcggcggcgcgggagtgccacctgattcactgcacttggaaccagatgatgttgggctctttccagaagtcaaatccttcctgggaggatgaagatctgccagctctgaggattctggctgggaagaaaaagagcctcaagctttgaaggccattcccatggtagacagagctgatgtgaaaagtggccatcctgttgccccaggcacatgaccttctgaagtgaccaggctgaaagggaagcaatactcgtgtgatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagagtcacattttcttgcttagtcatgtgtccctccttgagttgccccctccttgtgggtttacactacatttgggagtcattgtctaatgctgacaagcacaccctctcccattatttgtgcactacagatctcctcctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccagggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaa

SEQ ID NO: 151548 - DNA, 4575 bp, Homo sapiens
  Payload ID: 9834
  Gene Symbol: MANEA
  Gene Name: mannosidase, endo-alpha
  Uniprot ID: Q5SRI9
  ENST ID: ENST00000358812
  CDS Start-End: 135-1523
gtctgggctcggggcgcggcggcagtcagctctatgttcgcggtcttaacctctcctctggccgagtccttgcaagaagtgaattacccgaccctgcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaaatcactatgaaaccttccaaagcctctgaacttaacttggatgaactaccacctctgaacaattatctacatgtattttattacagttggtatggaaatccacaatttgatggtaaatatatacattggaatcatccagtgttagagcattgggaccctagaatagccaagaattatccacaagggagacacaaccctccagatgacattggctccagcttttatcctgaattgggaagttacagttctcgggatccttctgtcatagaaactcacatgagacaaatgcgctcagcttcaattggtgtactagccctctcttggtacccacctgatgtaaatgatgaaaatggagaacctactgataacttggtacccactattttggataaagctcataaatataacctaaaggttacttttcacatagaaccatatagcaatcgagatgatcaaaacatgtacaaaaatgtcaagtatattatagacaaatatggaaatcatccggccttttacaggtacaagacgaagactggcaatgctcttcctatgttttatgtctatgattcctatattaccaagcctgaaaaatgggccaatctgttaaccacctcagggtctcggagtattcgcaattctccttatgatggactgtttattgcccttctggtagaagaaaaacataagtatgatattcttcaaagtggttttgatggaatttacacatattttgccacaaatggctttacttatggctcatcacatcagaattgggctagcctaaaattattttgtgataaatacaacttaatatttatcccaagtgtgggcccaggatacatagataccagcatccgtccatggaacacgcaaaacactcggaaccgaatcaatgggaagtattatgaaattggtctgagtgccgcacttcagacacgccccagcttaatttctatcacctcttttaatgagtggcatgaaggaactcagattgaaaaagctgttcccaaaagaaccagtaatacagtgtacctagattaccgtcctcataaaccaggtctttacctagaactgactcgcaagtggtctgaaaaatacagtaaggaaagagcaacttatgcattagatcgccagctgcctgtttcttaatgcattgattaaagtttaatagttatcaaaatcacctaatttttaaaaatagctttcgttttgagttctggaaagaaaactgtcaaaatcagtatatactattagttatatttaaaaatatttttttaaattctttacagataatattatacttgttacccttcacaataccacatgagaaaatatctgagacaaaatgtatacaaatatattccttatggcataatttattgcatttctgactgaaatcaaaattctgatttgatggcaattgaattttcattttacaatagataaatgcttgtgctacctaaagcacttagcacacagttaaattatatttacatcctagacccaaataaataggattgtgtgtatatttgggatatctattgaagaaaaaaagaaaaccccttaaagataatgtacatgcttcatgtcatgtctttaaaataatttaatcaactttattgtcttagtatttagactctggataactctacaataatgaggaaattcttaagaataacaaaatcactgtaccttcctctcaattttgctgtgaacctgaaatggctttaaattaatactcttattttttatttaatttaattacataaattaaaccttaccatgaccaaattgtgttaggacggcctgctatctacagcacagtgtgtcatttgcagatttgtggttacctataccacgctaggtgttttgacatgtttagtgtttctgctttacagtgctgaattccatattttagaagctatgaaagtccttttatgaaaaagttactgattgcttctcagttattaggaaaacagttgtttcacaattattatgtagatatgatgcccaaatatcatttttagtatatcttgtcgatctttaagttgttactattgtgttattcatgtctttaaatcagataccaaatattttttaggaaagaaaaatgttattactgtcattaggttgtcttttaatactttaagttattttgacgaaaagtaatagagaaaatttacttagcattttagattctagagacatggaaatgaaaattattttatgtctagagtaggtcctgaagtttggctttacattaagtttagcactgtatcagaatgaagaaactaatattttacataaaaactaatactttcaattttttatatagtaatatccccattttgtaaatgttagacttttatcatacctgtaagttaaaatacttgttatcaataacttgtcatgttgtgacaaattgatcacttgtgtacgaaaaataaatctccttaaaaactaaataaaatgcactgtattcttacagttaatgtttataactatagtaaaaaattaatatatatcctattacataaatgttatttcttaggtgttccattaagaagagcaatagaataatgctaaaaaataatgcctataaatcttcagagtataaagacatccattcagaaacaaaaattagcactaaattttttataaaatagaccagatgacaaaatttattttatttttaaacagtggttttgacacaaattatgttattgaaaagcattattaatgtttaatttatttaaaattttggaatttgccatttctcagagaatgatcaggccttaggaaattaatacagtagtagtaatcattttctaggggaaaataaaagaataaatcactatactgatattttgatacaagcaagcacttacatggtaatcactatatagatccaacctgtggattttcttcttatgtccatttaactagaatatattattttaggtataatttacaaatgtcacacctaataatcttttataatataccatatttcattaaagttttgttagagaagtatctaccacagaggagtttttgtcattgtgtacgttgtgtatttgaacccaccatgacagaaagtaaattttaggaaatagttatgagattaagggaaaatctataaaaacaaggttagcatattctcaacacagataccaccactttctttttcccattatagacatggtgaatccacacagcatacttcatctctgagctttgttgtgattcctcaacacattaccctaaccagccagcagtaacagatttcagagtaagataaagcagattctgtcttcattgcaaaaagttattctcaatggaagaatggcatctgatctcataattactagtttatattaatatagtttttttctccctttttaataaaataattacagtcatccctcagtgtctgtgggggattggttccagttacccctatagataccaaaatctgcagatgctcaagtccctgatataaactggcatagtagttgcatataatctatgcacatcctcctgtatacattaagtcatctctagattatttataacacttaatacaatgtaaatgctatgtagttgttataccatactggttagtgaataattacatgaaaaaaaagagtctgtacatcttcagagtttcagtcggcaatttcttggccatggatgtagaacctacagataaggtgagccaactgcattaggaaataactctaataattctgttaattcttagagaggaaaactttcaaaatcttcctcaggtatttattacaactgcctttaccattttagttgtaacacagtttaaattgttatgataacaagtaaataagagcaaagaatgtatttcttaattcaaaactatacgtttgaattcaatatggtataacttaaagtggtataatacatacaatgcatgaatcataatggattcttttataagttattaatttttatggtttaatcagtctaattgttttgactgttatagaaaccaaatattttactgtttcttttaaggactaatattgtcaaaaactgctgttattaacttcacttgagttgtttaacttccttctgttttaagattgtaattaaaaattactattttgttatatggaatggttaatttttacctaataaaaacatagatgaaatacattgtatttta

SEQ ID NO: 151549 - DNA, 1076 bp, Homo sapiens
  Payload ID: 9834
  Gene Symbol: MANEA
  Gene Name: mannosidase, endo-alpha
  ENST ID: ENST00000369293
  CDS Start-End: 135-731
gtctgggctcggggcgcggcggcagtcagctctatgttcgcggtcttaacctctcctctggccgagtccttgcaagaagtgaattacccgaccctgcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaaatcactatgaaaccttccaaagcctctgaacttaacttggatgaactaccacctctgaacaattatctacatgtattttattacagttggtatggaaatccacaatttgatggtaaatatatacattggaatcatccagtgttagagcattgggaccctagaatagccaagaattatccacaagggagacacaaccctccagatgacattggctccagcttttatcctgaattgggaagttacagttctcgggatccttctgtcatagaaactcacatgagacaaatgcgctcagcttcaattggtaattattgtatatatatatatgtgtgtttgtgtctgtatatatgcatataaatgattttttgtgtaactttactagttaattttctcattattattaattatattgttaagctcatacctccaaattaaactgtatgtatgatcttaaacatccaggcaaccacattttaacactgcccttagtgtatattgtttaatttttacattttggagcatttctggatatattgttgatttctaatttaattcactttctcaattttattaaattatgatttacataaaatacaatgaatttcccactttaagtttatagctcattgatgttactcaaaagtatatacctgtttgaataccaccccaatcaagaagtaaaatatttctatagcccaaaaa

SEQ ID NO: 151550 - DNA, 1069 bp, Homo sapiens
  Payload ID: 9834
  Gene Symbol: MANEA
  Gene Name: mannosidase, endo-alpha
  ENST ID: ENST00000612218
  CDS Start-End: 135-758
gtctgggctcggggcgcggcggcagtcagctctatgttcgcggtcttaacctctcctctggccgagtccttgcaagaagtgaattacccgaccctgcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaaatcactatgaaaccttccaaagcctctgaacttaacttggatgaactaccacctctgaacaattatctacatgtattttattacagttggtatggaaatccacaatttgatggtaaatatatacattggaatcatccagtgttagagcattgggaccctagaatagccaagaattatccacaagggagacacaaccctccagatgacattggctccagcttttatcctgaattgggaagttacagttctcgggatccttctgtcatagaaactcacatgagacaaatgcgctcagcttcaattggtaattattgtatatatatatgtgtgtttgtgtctgtatatatgcatataaatgattttttgtgtaactttactagttaattttctcattattattaattatattgttaagctcatacctccaaattaaactgtatgtatgatcttaaacatccaggcaaccacattttaacactgcccttagtgtatattgtttaatttttacattttggagcatttctggatatattgttgatttctaatttaattcactttctcaattttattaaattatgatttacataaaatacaatgaatttcccactttaagtttatagctcattgatgttactcaaaagtatatacctgtttgaataccaccccaatcaagaagtaaaatatttctatagccc

SEQ ID NO: 151551 - DNA, 1930 bp, Homo sapiens
  Payload ID: 9835
  Gene Symbol: MANEAL
  Gene Name: mannosidase, endo-alpha-like
  Uniprot ID: Q5VSG8
  ENST ID: ENST00000329006
  CDS Start-End: 289-996
agtctaaagcctggctcccttccggcctggcgcgctacggttcccgcaggcgctccgcttcagcaccgcgggcgtggacagctccggggcgcgaggctctgggactcatctgcaggaagtgaacctggcaggaggcttgcttcaggtttttaggaaccatttttgcaattggagatgtttgtgaggaaaaaaatctctgttgaggggggtactgtgtgtctctgaagtggcctctgtgttgcgtctcaggcgtcctggtcctgtcctggtacccacctggcatggctgatgataacggggagccctcagatgacctggtgcccgccattctggacaccgcccatcagtacagcatccaggtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccactcactcgttcccaggtcagaggtcagcagatgggtgtttctgggtgggccgtcaggcatgggcctgtgcaacacagagcccgttcctcaggcgagtggtgctgaggtgctctgtggtgatgggaacggcagaggctggcaggtgactgaacttagcccagggcagctccacatcctgggaacactttcatgtaaccccttctagttttgaactctgcagcaggctggtgctgtgtagtggccacccagtcaccacccttggaagggtgtcagggtctgggctcgcatgcaccctgctcccttctgccagcctgcatcctctcctcaggcctccttcccacatcatctgtcttctctaagttagggaaccatatttgagactttcaaaaagggaacttctaggtttaagctcctcccagtagattcctgaacccaattatcaggaaatcatcctgagcactcacaggttcatttaacactcactcatcaagcaccttcctatgtgctaggtgctggggaaaacttgaccaaggaagagttcctgtcctgaagcttccaggacccagctttccttttctggtgtggccttgtagctagtgcctgggcacaggtgtttttctttttgcagttttacctagtgctgggagttcagttctttttcctctagaaaaatacctctgtgctccagagcctaatttttcccagatgcatatttagctctagggagaggactaggaggaaatccccctccctttagctgcctgaactgactgaggcccactcactagagccatgttcagtgctactgtgattagtagtaattaaatatgaactggtattctcaagtaa

SEQ ID NO: 151552 - DNA, 2685 bp, Homo sapiens
  Payload ID: 9835
  Gene Symbol: MANEAL
  Gene Name: mannosidase, endo-alpha-like
  Uniprot ID: Q5VSG8
  ENST ID: ENST00000373045
  CDS Start-End: 382-1755
cctctctcccgcgctccggaaggcctgcgtccccgctccccagccaggcgccaccacctgccgcccaggcagccaggcgactcttctttcgcgggtcacgcggcctgactcaggcccctgctcctgtggccccgaaactcgccgttcgctgggccttgcgttgcactcggcgtgcagttccccctcggctcgcggccacttggtccgcgccgcctgcgtcctgtgtgccgagcccgcccgcactgcggggacaggccgggcgccgcccacgccgcgctctgccgggcgcacagtctgcctgggaagcgcgcggccgggcgggcggccatggcgcggcacgctgggaggtagcgcggcggctgcaggagcgcacagtcggccatggcccggcggcggcgccgcgcctgcatcgctctgttcctggtgctgctcttcgccttcggcaccctcatgggtctgcgcacgctcaaggctccggacggactcccggcgctgggcccgggcctggagctggcgccctttgagcgacgcccagagggggcccccgcgcccgctgccagggccccggcagcccctgccgcgccgcccccgccgccgccgccgccccgcaccgcggaccctggcggctcccctgggccggcacccgcggaggccgagcccgcccccgtgcagagcctgcgcgtctactcggacctgcacgccttctactactcgtggtacgggagcccgcggcgcgagggccactacattcactgggaccacgtcatggtgccgcactgggaccccaagatctcggccagctacccccgcggccgccacagccccccagacgacttgggctccagcttctacccggagctggggccctacagctcccgggaccccgaagtgctgcgggagcatatgacccagctcaaggaagccgccatcggcgtcctggtcctgtcctggtacccacctggcatggctgatgataacggggagccctcagatgacctggtgcccgccattctggacaccgcccatcagtacagcatccaggtggccttccacatccaaccctacaagggccgggatgacatcactgtacatgacaacatcaagtacatcattgacacgtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccactcactcgttcccaggtcagaggtcagcagatgggtgtttctgggtgggccgtcaggcatgggcctgtgcaacacagagcccgttcctcaggcgagtggtgctgaggtgctctgtggtgatgggaacggcagaggctggcaggtgactgaacttagcccagggcagctccacatcctgggaacactttcatgtaaccccttctagttttgaactctgcagcaggctggtgctgtgtagtggccacccagtcaccacccttggaagggtgtcagggtctgggctcgcatgcaccctgctcccttctgccagcctgcatcctctcctcaggcctccttcccacatcatctgtcttctctaagttagggaaccatatttgagactttcaaaaagggaacttctaggtttaagctcctcccagtagattcctgaacccaattatcaggaaatcatcctgagcactcacaggttcatttaacactcactcatcaagcaccttcctatgtgctaggtgctggggaaaacttgaccaaggaagagttcctgtcctgaagcttccaggacccagctttccttttctggtgtggccttgtagctagtgcctgggcacaggtgtttttctttttgcagttttacctagtgctgggagttcagttctttttcctctagaaaaatacctctgtgctccagagcctaatttttcccagatgcatatttagctctagggagaggactaggaggaaatccccctccctttagctgcctgaactgactgaggcccactcactagagccatgttcagtgctactgtgattagtagtaattaaatatgaactggtattctcaa

SEQ ID NO: 151553 - DNA, 2327 bp, Homo sapiens
  Payload ID: 9835
  Gene Symbol: MANEAL
  Gene Name: mannosidase, endo-alpha-like
  Uniprot ID: Q5VSG8
  ENST ID: ENST00000397631
  CDS Start-End: 301-1053
tcttctttcgcgggtcacgcggcctgactcaggcccctgctcctgtggccccgaaactcgccgttcgctgggccttgcgttgcactcggcgtgcagttccccctcggctcgcggccacttggtccgcgccgcctgcgtcctgtgtgccgagcccgcccgcactgcggggacaggccgggcgccgcccacgccgcgctctgccgggcgcacagtctgcctgggaagcgcgcggccgggcgggcggccatggcgcggcacgctgggaggtagcgcggcggctgcaggagcgcacagtcggccatggcccggcggcggcgccgcgcctgcatcgctctgttcctggtgctgctcttcgccttcggcaccctcatgggtctgcgcacgctcaaggctccggacggactcccggcgctgggcccgggcctggagctggcgccctttgagcgacgcccagagggggcccccgcgcccgctgccagggccccggcagcccctgccgcgccgcccccgccgccgccgccgccccgcaccgcggaccctggcggctcccctgggccggcacccgcggaggccgagcccgcccccgtgcagagcctgcgcgtctactcggacctgcacgccttctactactcgtggtacgggagcccgcggcgcgagggccactacattcactgggaccacgtcatggtgccgcactgggaccccaagatctcggccagctacccccgcggccgccacagccccccagacgacttgggctccagcttctacccggagctggggccctacagctcccgggaccccgaagtgctgcgggagcatatgacccagctcaaggaagccgccatcggcgtcctggtcctgtcctggtacccacctggcatggctgatgataacggggagccctcagatgacctggtgcccgccattctggacaccgcccatcagtacagcatccaggtggccttccacatccaaccctacaagggccgggatgacatcactgtacatgacaacatcaagtacatcattgacacaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccactcactcgttcccaggtcagaggtcagcagatgggtgtttctgggtgggccgtcaggcatgggcctgtgcaacacagagcccgttcctcaggcgagtggtgctgaggtgctctgtggtgatgggaacggcagaggctggcaggtgactgaacttagcccagggcagctccacatcctgggaacactttcatgtaaccccttctagttttgaactctgcagcaggctggtgctgtgtagtggccacccagtcaccacccttggaagggtgtcagggtctgggctcgcatgcaccctgctcccttctgccagcctgcatcctctcctcaggcctccttcccacatcatctgtcttctctaagttagggaaccatatttgagactttcaaaaagggaacttctaggtttaagctcctcccagtagattcctgaacccaattatcaggaaatcatcctgagcactcacaggttcatttaacactcactcatcaagcaccttcctatgtgctaggtgctggggaaaacttgaccaaggaagagttcctgtcctgaagcttccaggacccagctttccttttctggtgtggccttgtagctagtgcctgggcacaggtgtttttctttttgcagttttacctagtgctgggagttcagttctttttcctctagaaaaatacctctgtgctccagagcctaatttttcccagatgcatatttagctctagggagaggactaggaggaaatccccctccctttagctgcctgaactgactgaggcccactcactagagccatgttcagtgctactgtgattagtagtaattaaatatgaactggtattctcaa

SEQ ID NO: 151554 - DNA, 1015 bp, Homo sapiens
  Payload ID: 9835
  Gene Symbol: MANEAL
  Gene Name: mannosidase, endo-alpha-like
  ENST ID: ENST00000532512
  CDS Start-End: 1-393
gtctactcggacctgcacgccttctactactcgtggtacgggagcccgcggcgcgagggccactacattcactgggaccacgtcatggtgccgcactgggaccccaagatctcggccagctacccccgcggccgccacagccccccagacgacttgggctccagcttctacccggagctggggccctacagctcccgggaccccgaagtgctgcgggagcatatgacccagctcaaggaagccgccatcggcgtcctggtcctgtcctggtacccacctggcatggctgatgataacggggagccctcagatgacctggtgcccgccattctggacaccgcccatcagtacagcatccaggtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcg

SEQ ID NO: 151555 - DNA, 1294 bp, Homo sapiens
  Payload ID: 9835
  Gene Symbol: MANEAL
  Gene Name: mannosidase, endo-alpha-like
  ENST ID: ENST00000525897
  CDS Start-End: 258-1049
ttcttcagaggtaggcctgtggcttccaggtgggtgtggcactgtcctcccattccctttgttctactacttgctgaggcagtctaaagcctggctcccttccggcctggcgcgctacggttcccgcaggcgctccgcttcagcaccgcgggcgtggacagctccggggcgcgaggctctgggactcatctgcaggaagtgaacctggcaggaggcttgcttcaggcgtcctggtcctgtcctggtacccacctggcatggctgatgataacggggagccctcagatgacctggtgcccgccattctggacaccgcccatcagtacagcatccaggtggccttccacatccaaccctacaagggccgggatgacatcactgtacatgacaacatcaagtacatcattgacacgtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccactcactcgttcccaggtcagaggtcagcagatgggtgtttctgggtgggccgtcaggcatgggcctgtgcaacacagagcccgttcctcaggcgagtggtgctgaggtgctctgtggtgatgggaacggcagaggctggcaggtgactgaacttagccca

SEQ ID NO: 151556 - DNA, 2761 bp, Homo sapiens
  Payload ID: 9836
  Gene Symbol: MGAT1
  Gene Name: mannosyl (alpha-1,3-)-glycoprotein beta-1,2-N-acetylglucosaminyltransferase
  Uniprot ID: P26572
  ENST ID: ENST00000307826
  CDS Start-End: 333-1670
cccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 151557 - DNA, 8863 bp, Homo sapiens
  Payload ID: 9836
  Gene Symbol: MGAT1
  Gene Name: mannosyl (alpha-1,3-)-glycoprotein beta-1,2-N-acetylglucosaminyltransferase
  Uniprot ID: P26572
  ENST ID: ENST00000333055
  CDS Start-End: 674-2011
ggcttttgactgactggatgtgggaatgttgtggaagacttctggcctgccatttcctgagaacgggactgctgagagaggagctgggaggagcactgcaaatttcactttggacacgtgagtcagagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagggaggtaacggacccctgagaggggcactgaagtctgcagtggggggggaggggcctggacacaccccttcccccccagactcctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaatatttatgtgtgtgtgtcctggaaaaggaggtggcaggcagggaaagaaaggaaaagggagaatgaagagttaaggagagggctagacgggtgggaggaagcaaagttgaggaaagaaagcagatgagtgggagggaagagccagggacagcccaggggatgggggccaggtgggaaaggaagtccaggccacaaggtggagaggagccccggactgtgctcctgctgatcgtcctgtagagccaggaggccgcagcaggaaagctggtgagtgtctcctgcttctgcctcctgctggctgggcaggcctggtctggggaagaaccaggtcctctgatcagggtggtccctgagtggtgctttgtgcccggtgccctctgctggcccaggcagtgcttattgagtgccctttatgacgtgccggggagcctcagggtacacagctgataccagggttggcctcacagtggcgcttggactcccaaacgcaaccccagtgagagtgcctgttttgctaatacccagaacacagacagactgttacctctgcatatcacgtgcaacattctgagagtttctgttctccactaattcatttaaaagaacaaaacgcggccgggcgcagtggcttacacatgtaatcccagcactttgggaggctgaggcggacggatcacgaagtcaggagttcgggaccatcctggccaacatggtgaaacctaaaaatactctactaaaaatacaaaaacttgctgggcatggtggcacacacctgtaatcccagctactcaggaagctgaggctggagaatcacttgaacccgggaggcagaggttgcagtaatccaagatcataccactgcactccagcctgggcgacagagcaagactctgtctcggaaaaacaaaacgctttttgtgactcacgaacttgatttcatgagtgggtttgaaaaccctgggctagtccaggcgcggtggctcacgcctgtaatcccagtactttgggaggctgaggcgggtggatcacttcaggagtttgagaccagcctggctaacatggtgaaaccccatctctactaaaaatacaaaaattagctgggtgtggtggcacatgcctgtaattccagctacttgggaggctgaggcaggagaattgcttgaacccgggacggggtggttgcagtgacctgagatcgcaccactgcactccagcctgggcggtaagagcgaaactgcgtctcaaaacaaaacaaaccaaaaaccctgggctaggcaactttcttggcagaaactactttggagctcgacaccagatggtggcagagttgtctggggagctgtgtcgagggccgtggccttgggagcagctccaacctcccatctgggctcagaaaccagtgtcagacattggttttattttaacctttgagatttgtgtggagcgggttttgccttcccctgttgcttagatggattatttagccatattttttgttaaataaggggaggtggtcattatccgtgatttcagacgtggaatcggcccggcgatagctgcattgtgccctttccggtggagccaggaggagtttggccgccacgctccatgcgcatagcatgtcatgcagctagccaagtgcattgttctgagtgctccaggataagtaccaacttacttagtgctccaggataagtaccaacttagtgctccaggataagtaccaacttacttagtgctccaggataagtaccaacttacttagtgctccaggataagtaccaacttacttagtgctccaggataagtaccaacttacttagtgctccaggataagtaccaacttacttagtgctccaggataagtaccaacttacttagtgctccaggataagtaccaacttacttgatcctcagagcaagcctaggcggtgggtactgttttgctcctgttttaccagtgaggaagcaggcacacagaggtgaagttgcccaaggtcacacagatggttgagggagagccggattggaatgaactctgtgctgttagccactgtgtgaggctggactgttccattccagcctttacggcctcttccaggccattccccagctgcacttggattctcaggccaggcaccggcggtctcctgtgagggtggagaggaagagggggctgcgtggctcggggaggtccaggagagatggcgggaggagtagagtttggggcctgcggtgccagaggacccccttacaagacgaaagactgggttctcaggctcctgaagcaaggagcaccttcaggggtctcctggtattcacccatcaaggcttgctcaggtggcatgcgtgtgtgcgtggcggctgcccccgggcccggaagcgcctgtggataccaaagcaagtggaaatgccagatggaaaagccccgtgttagtcaatgctgtagagttcagccagcctcgagtttgcaggtttacagagctgccttgcgcctggctgctgctgctgctgcattcctgcttctgcctccagctgtgaccacctcctgccactcctgctctcactgtgggttcctgctcactctgtctccaggacagactgccttccgggcagccttccctcctcaagcctcttggcctttgcaatcctcttacctgggtcactggtgggatctcatttgtggatcaagtcgcccccagtggagacaaatgtctgatggagtctggccaaggccctcctgagccttcactgggccctgcatgagaagcctgccaaggctgaggggccagggaaacggagacgaagccctcagagcaggccaagagggtgggaggtggggggcatttagagggttagatacagagcacccctttacaaataccagctactggcttttcgtattacatgttcattttagatacaacatactgcacacgctcccttaacgtgtgtttacgcgtgggtggtgtatccttccagacgtcttcctcacatctatacataatatgcatagataaaacatttaccaccaaaacccatagtgttatgtacatatttgtctggctgtgtaactttaaataacatacaaatgtatagaacagaagcttgccctctttctgaaatatctaacgtgggatttcaggctttctgatgagacctctgtagaggtcagtgttttgccaccagaggtccttcagcctccatctgttctcccacctacccacattctggcccctggcaattcacagggagtttaggaagtagacaccagggccctatttcctggagaccagcctggtggccgatgtcatagagtgcggtgggcctgggccggccctgctctgggcccgtgacctgcgtgtctgactcgggtccagctgttcttcctgccagagcctcttcctgtgaggcgggggtaacacaaccttctgtggtggctgtgggattaatccgtatggctgcattgtgagtaaagcctggtggaaatctctgtctccactgctttccttttcctgctgttcaccttggctccctcgacacttaatccccctccacatgtgtctggagcgggcagagcgggggcagttgatagaaagggggccgggtagtgccaaggctgttactttcccccactgcctcccttggctaacttgaagtctgaccctttataccagaactgtaagacagtgtgtcagaatggattcagttgcagagcaggaagcctggatcccagcgccggacggaaatgagaggtcgatggtgcaggctggtgtgggggttcctccaccgtcagggcccaggctccttctcaggtctcagtctcactcttcttagcacgaggtcaggtctcattccttggctgcgggagctccagccagcacacgttttaggaagaaggaggaaggaagaaggtaaagggtggatggcagctgcctcctcctctcttggaagctcacagagcgctgggtcacaattccctgggtagaactggatcacacaggcacccctgtcagcaaaagaggctggaaaaagtatttctgaagctgaatcaaattaagattcctgttactaagaagggagtgattgtatgggcgactacagggaccacggccatacacggtgcctggaagaccaagcttgtgacagtgacgaggatttggagagggcagggtgatggggagctttggggggagtgcattaggaaccctgacctggagaggggcagaatgaaacctgcgggcccctaaccctagtgggttgtttgagaaacctgtcctactgtggcagggggctgagtcttctcagggtcatgcatgaaaactgaaattcctgaaggccacacacagccccggaagtgctgactgacaagggcacatgccagtgatgcagttttcttttttgtcttcacttttgttgttccgccgtcttcaacacatggctcccagctcacagcaaatgctgccctggttcagctaccaggaagcaggagaggggaagggagggcaagcctcattctttatggaacaaaagcagtgggcagacagccttccctcacgttccactcactggaatgtggtctggctgccttccctgcaggaggtgggatgcaccctcagtgcagcagccctgccccagccaaaaacgtctcagcacagctgtaagaagaggaagatggctagagacaggcagccttccctgcaagggcaatgaggcaagcctgccaaaagcctcctttggaaatactgtttgattacttttcagagtttctatttaggaaaagggcaaaacctttcaggatcaggagtaggtgagcggcgatcaggcctcactcttcaccgagggccttccctgaggaggggcctgcaggacgctggcagcggaatggggctgtgtggctgctagattaggtcatggcagggagacagcctcttcctggttcttgctagaacaggcacacttggggccttgagctccagggagttcatggaagacatctgactaccctgagccccttgctggagggttctggggagtggcccacggccaccgtcacccatggccaccgtcacccacaggggccgtgaggacatccctggccagcatctaacacaaccacatgggatgccctaagcaactactgcccagccgagggctgcctgaatttctgactcacaaatggtgggcaatgtgaaacgggtattttaagctgctgagttctgcgggagtttgctgagcaacagtagaaaccagaactctcggatactgtgttctgtccttgaaacggtggaagattttatgtgaccagaatggaatgtttgaacaaatattttgagaatagaattttaaaacatttactcatcagcatccaagggtggggagcagtgtcatctaggagactggttctattatttacgtagatgttcttgaattaaaggatgggaatattttttccttccaaaactttttttcaattttatattctgtttttcaagtttttattatgaaaatattcaaactcacagggaagttgaaagactaatacaaagaagaaccatactctttccactgacatgatccaacgaggaatattttgccacacggcaaatatataccgtataattttctgtaccacttgatagaaaggtaaagaatgaatattgttttttaaataacttttttcgtatataagtaatatgtgcttatcgtgtaactacctaaaaacattgaaaaataaaaggaaaataaaattcatacataa

SEQ ID NO: 151558 - DNA, 3077 bp, Homo sapiens
  Payload ID: 9836
  Gene Symbol: MGAT1
  Gene Name: mannosyl (alpha-1,3-)-glycoprotein beta-1,2-N-acetylglucosaminyltransferase
  Uniprot ID: P26572
  ENST ID: ENST00000393340
  CDS Start-End: 654-1991
gtggggcctgggccagcgctggggatcgggcctggggcctggattgcgacccgcggcgggccgcggctcctagccgagacggggcgggcgggaaccaggttaacacagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagggaggtaacggacccctgagaggggcactgaagtctgcagtggggggggaggggcctggacacaccccttcccccccagactcctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctg

SEQ ID NO: 151559 - DNA, 1919 bp, Homo sapiens
  Payload ID: 9836
  Gene Symbol: MGAT1
  Gene Name: mannosyl (alpha-1,3-)-glycoprotein beta-1,2-N-acetylglucosaminyltransferase
  Uniprot ID: P26572
  ENST ID: ENST00000427865
  CDS Start-End: 430-1767
ctgatcacatggcagcagcccttcttggggaagtcagctacccagcagcctgtagtcctcggctacccaccctcaccgcctggggtcccatggtgagacagctgggtgggcatcaggcttctgcagagggccaggccggagggagctgggcgagggagtggggctggctcctggcttgcaccggcctcgtggaatccaggcctcagacctgatcgctggcgaaactggctctgtgcgctggagcccctggtcttctgcgtctgtcctcctcccggccagactttactcctggctcagcgacaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataa

SEQ ID NO: 151560 - DNA, 3175 bp, Homo sapiens
  Payload ID: 9836
  Gene Symbol: MGAT1
  Gene Name: mannosyl (alpha-1,3-)-glycoprotein beta-1,2-N-acetylglucosaminyltransferase
  Uniprot ID: P26572
  ENST ID: ENST00000446023
  CDS Start-End: 752-2089
gtgtggatggatgtgtgttgagagagagaatggatgtgtgtgtgtttacgaataaacttggaggggagggggcaacaggggtgggttttcgggctgagaaatgggaacactgtggggctgctgcaagcaggacttgggccttaaacattccaggagagtgttctcgggagtagccccgggaaggactttaacagaggttaacacagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagggaggtaacggacccctgagaggggcactgaagtctgcagtggggggggaggggcctggacacaccccttcccccccagactcctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctg

SEQ ID NO: 151561 - DNA, 607 bp, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENST ID: ENST00000514438
  CDS Start-End: 294-607
gaaaagagccacgaaataaccgggagacaagctttcggaggcttttgactgactggatgtgggaatgttgtggaagacttctggcctgccatttcctgagaacgggactgctgagagaggagctgggaggagcactgcaaatttcactttggacacgtgagtcagaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggt

SEQ ID NO: 151562 - DNA, 693 bp, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENST ID: ENST00000502678
  CDS Start-End: 384-693
gagagaagctgcactttggtggatctgatttgggattctcagttttgaaaatggagtgctgaatggggatttgatgatctcctggagagcaactgagacaagagaagaaaggtaaggctcctgtctcatttcccacttaatgtcttgctgtgcctgtgcagaaggtgttgagctggcgagttcgcggaggctactattcaggaaatcttatccagatgagtacactggaagctacacctctccattactctgtccaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccgg

SEQ ID NO: 151563 - DNA, 564 bp, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENST ID: ENST00000506269
  CDS Start-End: 231-564
ctctcttcgctttctttactcagaactgaagctctcattccccacccaccaaggaaaaacaaaagggaagaagccacagctggccccggcttgctttggcacaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcg

SEQ ID NO: 151564 - DNA, 555 bp, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENST ID: ENST00000513431
  CDS Start-End: 270-555
aaataaccgggagacaagctttcggaggcttttgactgactggatgtgggaatgttgtggaagacttctggcctgccatttcctgagaacgggactgctgagagaggagctgggaggagcactgcaaatttcactttggacacgtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgc

SEQ ID NO: 151565 - DNA, 619 bp, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENST ID: ENST00000514283
  CDS Start-End: 238-619
gatgtcaggggcgtgggtcctgatcacatggcagcagcccttcttggggaagtcagctacccagcagcctgtagtcctcggctacccaccctcaccgcctggggtcccatggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcatt

SEQ ID NO: 151566 - DNA, 878 bp, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENST ID: ENST00000504671
  CDS Start-End: 280-878
ggcgagtcgaaaggcgaggcggccgcggcagcgcttgggacgcgcctgggcaccgggctcgctccctgcgccccggagcaggccaagttcggggccaggacgtcgggaggacctgagcctggcagagagcaggtgtgtgatacacgtcgtcaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtt

SEQ ID NO: 151567 - DNA, 1104 bp, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENST ID: ENST00000506889
  CDS Start-End: 644-1104
ggccagcgctggggatcgggcctggggcctggattgcgacccgcggcgggccgcggctcctagccgagacggggcgggcgggaaccaggttaacacagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagggaggtaacggacccctgagaggggcactgaagtctgcagtggggggggaggggcctggacacaccccttcccccccagactcctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctc

SEQ ID NO: 151568 - DNA, 549 bp, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENST ID: ENST00000512695
  CDS Start-End: 203-549
aggcttttccatggtgcttccgccaaagcttgtgaccgagtccttcccgcctagggctggtgggcctcccctgctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcag

SEQ ID NO: 151569 - DNA, 572 bp, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENST ID: ENST00000507384
  CDS Start-End: 471-572
gaaagggctggcgagtcgaaaggcgaggcggccgcggcagcgcttgggacgcgcctgggcaccgggctcgctccctgcgccccggagcaggccaagttcggggccaggacgtcgggaggacctgagcctggcagagagcaggtgtgtgatacacgtcgtcaggtgactgaccgaggaattcagggcaaacagatcatctcaatttgccttgctgatgtgccagctgggattacgctgatggatgaagctcttcagagctatgggcaatatctacatatttgattgtcaagaaacttcgtgtggaaatagcttcaaacttacacaaattgcaagaataaaaaatagtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacct

SEQ ID NO: 151570 - DNA, 8432 bp, Homo sapiens
  Payload ID: 9837
  Gene Symbol: MGAT4A
  Gene Name: mannosyl (alpha-1,3-)-glycoprotein beta-1,4-N-acetylglucosaminyltransferase, isozyme A
  Uniprot ID: Q9UM21
  ENST ID: ENST00000264968
  CDS Start-End: 365-1972
atgtagggataatctttatagatgcaatttagccctgccaaaagtctgtttataatgatgaatagtaaatgaagaaacttacattttgcattaccgaatgagcttgactttctcttttcccctgaataggaagggaaaaggccgaggcatcagcgtgtgaagaccgcaaagacgatcccgagtacagttgtgaacagcattgctgctaggctcctcctgcagatcatctgaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaagaaaaactgattgcttatcaacgagaattccttgctttgaaagaacgtcttcgaatagctgaacacagaatctcacagcgctcttctgaattaaatacgattgtgcaacagttcaagcgtgtaggagcagaaacaaatggaagtaaggatgcgttgaataagttttcagataataccctaaagctgttaaaggagttaacaagcaaaaaatctcttcaagtgccaagtatttattatcatttgcctcatttattgaaaaatgaaggaagtcttcaacctgctgtacagattggcaacggaagaacaggagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagattcatattaaaaaagccaccaactgatcatctgagaaaccaacacattttttcctgtgaatttgttaattaaagatagttaagcatgtatcttttttttatttctacttgaacactacctcttgtgaagtctactgtagataagacgattgtcatttccacttggaaagtgaatctcccataataattgtatttgtttgaaactaagctgtcctcagattttaacttgactcaaacatttttcaattatgacagcctgttaatatgacttgtactattttggtattatactaatacataagagttgtacatattgttacattctttaaatttgagaaaaactaatgttacatacattttatgaagggggtacttttgaggttcacttattttactattatagaccctcttttatagattatcagggattatatatataaatatataaatatacataaaaatgttatggaattaatttattagaaacacttaagaagtacatatttttgtgcagtagatttttgaatcgatactttttttgaaaaccagtttccttgcttttttaagttctttctatatttttctttggaaatgcaaacattacaaaccaatgccatttttcaaatgcactgccatttaagattgattatagatggatttcttaattgaagtacttttataatcacagtgactgaacaaaatattttcaaagacatttgtcattccttaaagccaagattttaaagactaatgtccttcctgagggttactttactatactgtgtatggtgtatagccacagaaagtcagtctgataaattttcaatgtgtaagtgtgatgcattcaacccagattattgtagacttaacttattatatttcctctgatatgtaaaatgacaaactcttctttcctttttaatctttgtctttaatccatgaattaggtgcattatctgctgttgattcttttatatctgcactcattttatgacgtcagacaaaatgttttctaggtgttgctattgtatgagtcataattggtataattttaaagaaaattgtaatattgttttttggtgaaatatattattagtagtatattttccaaaatgattttattgtagtatgaactgataagtgagtcccgtgtccaagagactgtatttattactcttaaacacgctattccaaatgatattactactataaacaaagaatattaccggtctcagcaatcagtgatctttataaaagtacttttaaaaaatgatgaattatcaccaggcgctgtggctcacgcctgtaatcccagcactttgggaggccgaggcgggcggatcacgaggtcaggagatcaagaccatcctggctaacacggtgaaaccctgtctctactaaaaatacaaaaaattagccaggcgtggtggcaggtgcctgtaatcccagctacttgggaggctgaggcaggagaatggcgtgaacccaggaggcagagctggcagtgagctgagatcgcaccactgcactccagcctgggcgacacagctagactccgtctcaaaaaaaaaaaaagatgaagtatcaacatcagttcccagccagtctgcttggacacactggggtgccacaagtgggttgcaggttggttgcagacgggcagagatggattctgctgagctttcagagtgaccactggctggggcctagcgctggggcaaggttccagctggctgcctctagcctggaggagcttcatctagttacccaatgtgctgaaccaacagcatgaaatagcatcatttcctgtgctgtgttacaaagtgcaaacgtttggaaacactgatacagtacaattatttccatcactccatgttgttataatttttagttacttttcttgattgaaaagtcaatcacattgccaaaaatgatttttatgtcagttaaaggccagttgaaatttttttattaggatgttttaaatttacttttcactttcttgaatttttttcttctcaaatttccttggcccagtgcccatgagcaaatttcattcaaaaacaggaataaccttttgtcataaaattttggcaccagcttggtatactaaattactgcaaagataactgagtaccagaagtaaaaatctctgcaggtgggcttaggagtactcttgggtccctggttcctcagttgccaactctggtttcatgaagaaagaccatgctctgaaaatctagggaggagaaagttattgcagcacctggtgtgatttgttacaacttctttaaagacagcctgcctggctagctttttcctgttttcatgcagtttgccctcccagcattggtccacctgttgttcccaagaaactcattcttgttcccaagactccttttagccaaatctttcctatcattccaggacttttttgtgcttctctccccatgaatctacccgtgcctagggtgtgtgccaggcacgtggcaggtggccagtcagcatctggatgtgagaccaattattccagcctgccctcctctttctctttttatcattttgtattatttttgagacagggtctcgctttgttgcccaggctggagtgcagtggtgctctcatagctcactgcagcctcgatctctggcctcaagcaatcctcctgcctcagcctcccaaagtgctgggattataggtgtgtgccaccatgtccagccccctttctctctcttaactccctctccctgctgtcgttgccatactcttgcatacacaatcggttgtctagtttttgattgtttgtgtgtatggtgtgtgctgtctctctgaccagatttcaggttcctgaggcgagcctgcagctcatactgctcatctgtcctctcctatggtgggtgctcagggcctctcactgttagttactccctcctttctgcccagttctgcactcaactagtagaagcagccatcctttccccaagcaggaaattgtagtggtcgcccttaagagcagtgtgagggcagaagattaagggaggggaagagtccctggaactggaagaaggtaaatactttgccttgagagggcgccgaatcattttaccaaaatagtaaatggaaaaagtgtcaaaggttgggactagttttaaaaacacatatagccagtagacacatgggggctgtttaaataaaaacatttttttacccggttctgccatcacacacactagtgacattccaagtactcagtggccatgtggagctagtggccaccacacttgacaccacggatgcagaacttttccatcactgcagaaagctctgttgaacagtactgtgtccagagtgctaattatgaacagcttagaaaccacaattaatacattctcatgaggttaaaagcagacatgggaatagaacataatgcaaatgatgatgaatattttgggtgagaagagaaagctgaggacccatttctaggattctaagatgtaagatttcttaagttctttatcttagtctcatgcattctccacatcacgcgctgtaccatactgtgtagtcagaacagacagtgtgattgaaaagctttggaaaaagttaacacaaaggattatttagcacataggctgtagatacgtatgtgtgtatttgttcaacaattggagatggttgaatacccttgaacaaagtgtgtatcttctcaaatcagtggttgcactagtcaataattagaaggtgttgttatttttaaaactataagcaaaattatgaaggcctttaaaaaatctatcataataatgaaaaagaggttgtctcccaacagtgctgtccctcaaagaaaagactggttatgtggaaacagcacgtttggagagattattctagtgaataacagtgtatatttgtggtaggcaaatttctaagaatgacccctactgacacccccaccaatgaccttgtataatatcctcccactttgagcatgggtggaacctgtttgatccatgattatatcatgttatgtagcaaaaggaagactgtctgggggtggctaatcaaatcttgtgactcctttaaaagcagagagttttctcgggctggtggcagaagtcaagagacaaagcagaaggacctcaggcaccattgctgttttaaggtagagggggctgcatgagaaggaatgcacatggctttgaggagctgagagaggccttggctaacagcaaaggagctgggaactgcagtcctacagccacgggaactgaattcagcccataagctcattcataggcttggaaaggcattcatctccagtctccagataagacccagcctggccaacactttgaatccagccttgtgagaccctaagccgagaactcacttaagcctgcttggacttctgacctacagaactatgagataataaatcagtggtgttttaagctgctaaatttgtggcaatttgttatgtaggaataggaaatgaatacagtattttaaaagaggtaaagaggaaatcttcatacttgattccctgtagtatgctggatatttcttggtaaatgcatgaataaagtctttagtagcaagtcatgtacctggaccttgttggggatgttctcgccagagatctcaattagtcttcattggacgtttgttggcaaagttgcagcatcttactgagtagcgtttggtaaaggaactgctagaatgagactataggaataggactgaaacagtgtgtaagggatcttttttatttctagaagaggtgttactttatactgatttagactgctctgagcctgtcagaagtaaattcaagaatgattaacagtggtattttagatacattaagagcaaaaataacctttgccttgtagagatcagataatctgtgtatcgagggatttaattttttttaaccaaaacttagtttctctttttatcatctagcacagatcaaatcctgtatgggccagccaaatgtttgtagtttgagaatgttttgcaaatacctctctgcttccaagccattaatagctaatgaagttttattttggtttgtccattaatttttctgcttatttttactgtattgccatgtccttgatacgagacaagtagaactaaaagagagaaaatgagaggttaagactgtcagaagatgagaaatgtgagtcataaccataccttagtgttttaagggaactttatccagtccaatccctttatagaaaaggaacttttccaagttatgttgcagtatttatagtgtgtaaaattttgtttgactttggtagttgtgcattttaaattatgaatcttatatgctacgataactagtatgcttactttctttaatgcatgtgatcatacaatgctaaaaaggtattttttaaagacccaaccaaactgaggattttgttatacatatctgtatcaacacctatatataaactcttcttcttacctgaaacactccttcacccggtttgggcactaactagatcattttcaaaggaacaaacaggaaggagcaagctggcactccagggtgcatctgagctgagaatttagaagacctcattcaagaaagtaaactgagcattgatgggaaagcactttgcgcgaagtaacattcccactgttaatgttgcagtcaaaattgtggaaaaaaaaaagtggtgctaaaattgttctgaaatgaagattgtttgttgtggggaatattttaatactcttggactttagggaggctattttatgtgtcacttgctcctagttgtttcattgtattagtaattagcaaactgtcctggaaccaagggtttggtacttttgcctgattagcattccattatttatttgaaatgctcagtgtttgctcaaatttggtgaaaatatcttttgaagacatattctctgagccttaaaaatggctgctatcgacagtactgtaagatgcactgccagtagatttgatacttttcatttcagtgtaggcagtaatgttttctaagaaagatttagaaatcagcaaagtgtaacaattgtgtttcatttatggaatggaaaaactgaagtgtcccattcagaacactttggaaaggttgtctgcattaggggatgtttctggaagcatcccttagagaagctgcctgaggaatctccttgccaggttgtaccagatttttttttttcttaaatgtattgtatatattttccttaaaatgtcttcattggctgaatgattcctatccgtagtaatattttaggtacttgttggatttttaaaggaagattatttattttcagatttgctgctataattgaaaacctagtaactggtcctgttgattgtgccttcatcactgtttctctgtgccacgaccgttcatgtgtatttgaaataaagaagtttaaaaagccatgttgaattcaagattccttctaataaaaataggtgaaacttaa

SEQ ID NO: 151571 - DNA, 8382 bp, Homo sapiens
  Payload ID: 9837
  Gene Symbol: MGAT4A
  Gene Name: mannosyl (alpha-1,3-)-glycoprotein beta-1,4-N-acetylglucosaminyltransferase, isozyme A
  Uniprot ID: Q9UM21
  ENST ID: ENST00000393487
  CDS Start-End: 315-1922
cgcagcggcggcggcagcggcggcggcggctacagcagctccgccggcagccgcgggagcacggcgacgccagcggcgggaagggaaaaggccgaggcatcagcgtgtgaagaccgcaaagacgatcccgagtacagttgtgaacagcattgctgctaggctcctcctgcagatcatctgaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaagaaaaactgattgcttatcaacgagaattccttgctttgaaagaacgtcttcgaatagctgaacacagaatctcacagcgctcttctgaattaaatacgattgtgcaacagttcaagcgtgtaggagcagaaacaaatggaagtaaggatgcgttgaataagttttcagataataccctaaagctgttaaaggagttaacaagcaaaaaatctcttcaagtgccaagtatttattatcatttgcctcatttattgaaaaatgaaggaagtcttcaacctgctgtacagattggcaacggaagaacaggagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagattcatattaaaaaagccaccaactgatcatctgagaaaccaacacattttttcctgtgaatttgttaattaaagatagttaagcatgtatcttttttttatttctacttgaacactacctcttgtgaagtctactgtagataagacgattgtcatttccacttggaaagtgaatctcccataataattgtatttgtttgaaactaagctgtcctcagattttaacttgactcaaacatttttcaattatgacagcctgttaatatgacttgtactattttggtattatactaatacataagagttgtacatattgttacattctttaaatttgagaaaaactaatgttacatacattttatgaagggggtacttttgaggttcacttattttactattatagaccctcttttatagattatcagggattatatatataaatatataaatatacataaaaatgttatggaattaatttattagaaacacttaagaagtacatatttttgtgcagtagatttttgaatcgatactttttttgaaaaccagtttccttgcttttttaagttctttctatatttttctttggaaatgcaaacattacaaaccaatgccatttttcaaatgcactgccatttaagattgattatagatggatttcttaattgaagtacttttataatcacagtgactgaacaaaatattttcaaagacatttgtcattccttaaagccaagattttaaagactaatgtccttcctgagggttactttactatactgtgtatggtgtatagccacagaaagtcagtctgataaattttcaatgtgtaagtgtgatgcattcaacccagattattgtagacttaacttattatatttcctctgatatgtaaaatgacaaactcttctttcctttttaatctttgtctttaatccatgaattaggtgcattatctgctgttgattcttttatatctgcactcattttatgacgtcagacaaaatgttttctaggtgttgctattgtatgagtcataattggtataattttaaagaaaattgtaatattgttttttggtgaaatatattattagtagtatattttccaaaatgattttattgtagtatgaactgataagtgagtcccgtgtccaagagactgtatttattactcttaaacacgctattccaaatgatattactactataaacaaagaatattaccggtctcagcaatcagtgatctttataaaagtacttttaaaaaatgatgaattatcaccaggcgctgtggctcacgcctgtaatcccagcactttgggaggccgaggcgggcggatcacgaggtcaggagatcaagaccatcctggctaacacggtgaaaccctgtctctactaaaaatacaaaaaattagccaggcgtggtggcaggtgcctgtaatcccagctacttgggaggctgaggcaggagaatggcgtgaacccaggaggcagagctggcagtgagctgagatcgcaccactgcactccagcctgggcgacacagctagactccgtctcaaaaaaaaaaaaagatgaagtatcaacatcagttcccagccagtctgcttggacacactggggtgccacaagtgggttgcaggttggttgcagacgggcagagatggattctgctgagctttcagagtgaccactggctggggcctagcgctggggcaaggttccagctggctgcctctagcctggaggagcttcatctagttacccaatgtgctgaaccaacagcatgaaatagcatcatttcctgtgctgtgttacaaagtgcaaacgtttggaaacactgatacagtacaattatttccatcactccatgttgttataatttttagttacttttcttgattgaaaagtcaatcacattgccaaaaatgatttttatgtcagttaaaggccagttgaaatttttttattaggatgttttaaatttacttttcactttcttgaatttttttcttctcaaatttccttggcccagtgcccatgagcaaatttcattcaaaaacaggaataaccttttgtcataaaattttggcaccagcttggtatactaaattactgcaaagataactgagtaccagaagtaaaaatctctgcaggtgggcttaggagtactcttgggtccctggttcctcagttgccaactctggtttcatgaagaaagaccatgctctgaaaatctagggaggagaaagttattgcagcacctggtgtgatttgttacaacttctttaaagacagcctgcctggctagctttttcctgttttcatgcagtttgccctcccagcattggtccacctgttgttcccaagaaactcattcttgttcccaagactccttttagccaaatctttcctatcattccaggacttttttgtgcttctctccccatgaatctacccgtgcctagggtgtgtgccaggcacgtggcaggtggccagtcagcatctggatgtgagaccaattattccagcctgccctcctctttctctttttatcattttgtattatttttgagacagggtctcgctttgttgcccaggctggagtgcagtggtgctctcatagctcactgcagcctcgatctctggcctcaagcaatcctcctgcctcagcctcccaaagtgctgggattataggtgtgtgccaccatgtccagccccctttctctctcttaactccctctccctgctgtcgttgccatactcttgcatacacaatcggttgtctagtttttgattgtttgtgtgtatggtgtgtgctgtctctctgaccagatttcaggttcctgaggcgagcctgcagctcatactgctcatctgtcctctcctatggtgggtgctcagggcctctcactgttagttactccctcctttctgcccagttctgcactcaactagtagaagcagccatcctttccccaagcaggaaattgtagtggtcgcccttaagagcagtgtgagggcagaagattaagggaggggaagagtccctggaactggaagaaggtaaatactttgccttgagagggcgccgaatcattttaccaaaatagtaaatggaaaaagtgtcaaaggttgggactagttttaaaaacacatatagccagtagacacatgggggctgtttaaataaaaacatttttttacccggttctgccatcacacacactagtgacattccaagtactcagtggccatgtggagctagtggccaccacacttgacaccacggatgcagaacttttccatcactgcagaaagctctgttgaacagtactgtgtccagagtgctaattatgaacagcttagaaaccacaattaatacattctcatgaggttaaaagcagacatgggaatagaacataatgcaaatgatgatgaatattttgggtgagaagagaaagctgaggacccatttctaggattctaagatgtaagatttcttaagttctttatcttagtctcatgcattctccacatcacgcgctgtaccatactgtgtagtcagaacagacagtgtgattgaaaagctttggaaaaagttaacacaaaggattatttagcacataggctgtagatacgtatgtgtgtatttgttcaacaattggagatggttgaatacccttgaacaaagtgtgtatcttctcaaatcagtggttgcactagtcaataattagaaggtgttgttatttttaaaactataagcaaaattatgaaggcctttaaaaaatctatcataataatgaaaaagaggttgtctcccaacagtgctgtccctcaaagaaaagactggttatgtggaaacagcacgtttggagagattattctagtgaataacagtgtatatttgtggtaggcaaatttctaagaatgacccctactgacacccccaccaatgaccttgtataatatcctcccactttgagcatgggtggaacctgtttgatccatgattatatcatgttatgtagcaaaaggaagactgtctgggggtggctaatcaaatcttgtgactcctttaaaagcagagagttttctcgggctggtggcagaagtcaagagacaaagcagaaggacctcaggcaccattgctgttttaaggtagagggggctgcatgagaaggaatgcacatggctttgaggagctgagagaggccttggctaacagcaaaggagctgggaactgcagtcctacagccacgggaactgaattcagcccataagctcattcataggcttggaaaggcattcatctccagtctccagataagacccagcctggccaacactttgaatccagccttgtgagaccctaagccgagaactcacttaagcctgcttggacttctgacctacagaactatgagataataaatcagtggtgttttaagctgctaaatttgtggcaatttgttatgtaggaataggaaatgaatacagtattttaaaagaggtaaagaggaaatcttcatacttgattccctgtagtatgctggatatttcttggtaaatgcatgaataaagtctttagtagcaagtcatgtacctggaccttgttggggatgttctcgccagagatctcaattagtcttcattggacgtttgttggcaaagttgcagcatcttactgagtagcgtttggtaaaggaactgctagaatgagactataggaataggactgaaacagtgtgtaagggatcttttttatttctagaagaggtgttactttatactgatttagactgctctgagcctgtcagaagtaaattcaagaatgattaacagtggtattttagatacattaagagcaaaaataacctttgccttgtagagatcagataatctgtgtatcgagggatttaattttttttaaccaaaacttagtttctctttttatcatctagcacagatcaaatcctgtatgggccagccaaatgtttgtagtttgagaatgttttgcaaatacctctctgcttccaagccattaatagctaatgaagttttattttggtttgtccattaatttttctgcttatttttactgtattgccatgtccttgatacgagacaagtagaactaaaagagagaaaatgagaggttaagactgtcagaagatgagaaatgtgagtcataaccataccttagtgttttaagggaactttatccagtccaatccctttatagaaaaggaacttttccaagttatgttgcagtatttatagtgtgtaaaattttgtttgactttggtagttgtgcattttaaattatgaatcttatatgctacgataactagtatgcttactttctttaatgcatgtgatcatacaatgctaaaaaggtattttttaaagacccaaccaaactgaggattttgttatacatatctgtatcaacacctatatataaactcttcttcttacctgaaacactccttcacccggtttgggcactaactagatcattttcaaaggaacaaacaggaaggagcaagctggcactccagggtgcatctgagctgagaatttagaagacctcattcaagaaagtaaactgagcattgatgggaaagcactttgcgcgaagtaacattcccactgttaatgttgcagtcaaaattgtggaaaaaaaaaagtggtgctaaaattgttctgaaatgaagattgtttgttgtggggaatattttaatactcttggactttagggaggctattttatgtgtcacttgctcctagttgtttcattgtattagtaattagcaaactgtcctggaaccaagggtttggtacttttgcctgattagcattccattatttatttgaaatgctcagtgtttgctcaaatttggtgaaaatatcttttgaagacatattctctgagccttaaaaatggctgctatcgacagtactgtaagatgcactgccagtagatttgatacttttcatttcagtgtaggcagtaatgttttctaagaaagatttagaaatcagcaaagtgtaacaattgtgtttcatttatggaatggaaaaactgaagtgtcccattcagaacactttggaaaggttgtctgcattaggggatgtttctggaagcatcccttagagaagctgcctgaggaatctccttgccaggttgtaccagatttttttttttcttaaatgtattgtatatattttccttaaaatgtcttcattggctgaatgattcctatccgtagtaatattttaggtacttgttggatttttaaaggaagattatttattttcagatttgctgctataattgaaaacctagtaactggtcctgttgattgtgccttcatcactgtttctctgtgccacgaccgttcatgtgtatttgaaataaagaagtttaaaaagccatgttgaattcaagattccttctaataaaaataggtgaaacttaa

SEQ ID NO: 151572 - DNA, 2018 bp, Homo sapiens
  Payload ID: 9837
  Gene Symbol: MGAT4A
  Gene Name: mannosyl (alpha-1,3-)-glycoprotein beta-1,4-N-acetylglucosaminyltransferase, isozyme A
  Uniprot ID: Q9UM21
  ENST ID: ENST00000409391
  CDS Start-End: 350-1957
aaaatcagtcaccataactttctttttacagacaaaacaaaaccaatgaggagggaatatagtttgaagctgttttgtatttttttccaggaggagaaggaccatataattccagaagggaaaaggccgaggcatcagcgtgtgaagaccgcaaagacgatcccgagtacagttgtgaacagcattgctgctaggctcctcctgcagatcatctgaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaagaaaaactgattgcttatcaacgagaattccttgctttgaaagaacgtcttcgaatagctgaacacagaatctcacagcgctcttctgaattaaatacgattgtgcaacagttcaagcgtgtaggagcagaaacaaatggaagtaaggatgcgttgaataagttttcagataataccctaaagctgttaaaggagttaacaagcaaaaaatctcttcaagtgccaagtatttattatcatttgcctcatttattgaaaaatgaaggaagtcttcaacctgctgtacagattggcaacggaagaacaggagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagattcatattaaaaaagccaccaactgatcatctgagaaaccaacacattttttcctgtgaatttgttaattaaagatagttaagcatg

SEQ ID NO: 151573 - DNA, 3709 bp, Homo sapiens
  Payload ID: 9837
  Gene Symbol: MGAT4A
  Gene Name: mannosyl (alpha-1,3-)-glycoprotein beta-1,4-N-acetylglucosaminyltransferase, isozyme A
  Uniprot ID: Q9UM21
  ENST ID: ENST00000414521
  CDS Start-End: 115-1386
agttgtaaaatacagtttgctgtttatacttcgcagccattcattttttagtgtgaagtttaatgtctttcatttttatcagttctttttttcttatggttaagccatgtgaaaatgaattacagtattacagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagcagagagttttctcgggctggtggcagaagtcaagagacaaagcagaaggacctcaggcaccattgctgttttaaggtagagggggctgcatgagaaggaatgcacatggctttgaggagctgagagaggccttggctaacagcaaaggagctgggaactgcagtcctacagccacgggaactgaattcagcccataagctcattcataggcttggaaaggcattcatctccagtctccagataagacccagcctggccaacactttgaatccagccttgtgagaccctaagccgagaactcacttaagcctgcttggacttctgacctacagaactatgagataataaatcagtggtgttttaagctgctaaatttgtggcaatttgttatgtaggaataggaaatgaatacagtattttaaaagaggtaaagaggaaatcttcatacttgattccctgtagtatgctggatatttcttggtaaatgcatgaataaagtctttagtagcaagtcatgtacctggaccttgttggggatgttctcgccagagatctcaattagtcttcattggacgtttgttggcaaagttgcagcatcttactgagtagcgtttggtaaaggaactgctagaatgagactataggaataggactgaaacagtgtgtaagggatcttttttatttctagaagaggtgttactttatactgatttagactgctctgagcctgtcagaagtaaattcaagaatgattaacagtggtattttagatacattaagagcaaaaataacctttgccttgtagagatcagataatctgtgtatcgagggatttaattttttttaaccaaaacttagtttctctttttatcatctagcacagatcaaatcctgtatgggccagccaaatgtttgtagtttgagaatgttttgcaaatacctctctgcttccaagccattaatagctaatgaagttttattttggtttgtccattaatttttctgcttatttttactgtattgccatgtccttgatacgagacaagtagaactaaaagagagaaaatgagaggttaagactgtcagaagatgagaaatgtgagtcataaccataccttagtgttttaagggaactttatccagtccaatccctttatagaaaaggaacttttccaagttatgttgcagtatttatagtgtgtaaaattttgtttgactttggtagttgtgcattttaaattatgaatcttatatgctacgataactagtatgcttactttctttaatgcatgtgatcatacaatgctaaaaaggtattttttaaagacccaaccaaactgaggattttgttatacatatctgtatcaacacctatatataaactcttcttcttacctgaaacactccttcacccggtttgggcactaactagatcattttcaaaggaacaaacaggaaggagcaagctggcactccagggtgcatctgagctgagaatttagaagacctcattcaagaaagtaaactgagcattgatgggaaagcactttgcgcgaagtaacattcccactgttaatgttgcagtcaaaattgtggaaaaaaaaaagtggtgctaaaattgttctgaaatgaagattgtttgttgtggggaatattttaatactcttggactttagggaggctattttatgtgtcacttgctcctagttgtttcattgtattagtaattagcaaactgtcctggaaccaagggtttggtacttttgcctgattagcattccattatttatttgaaatgctcagtgtttgctcaaatttggtgaaaatatcttttgaagacatattctctgagccttaaaaatggctgctatcgacagtactgtaagatgcactgccagtagatttgatacttttcatttcagtgtaggcagtaatgttttctaagaaagatttagaaatcagcaaagtgtaacaattgtgtttcatttatggaatggaaaaactgaagtgtcccattcagaacactttggaaaggttgtctgcattaggggatgtttctggaagcatcccttagagaagctgcctgaggaatctccttgccaggttgtaccagatttttttttttcttaaatgtattgtatatattttccttaaaatgtcttcattggctgaatgattcctatccgtagtaatattttaggtacttgttggatttttaaaggaagattatttattttcagatttgctgctataattgaaaacctagtaactggtcctgttgattgtgccttcatcactgtttctctgtgccacgaccgttcatgtgtatttgaaataaagaagtttaaaaagccatgttgaattcaagattccttctaataaaaataggtgaaactt

SEQ ID NO: 151574 - DNA, 683 bp, Homo sapiens
  Payload ID: 9837
  Gene Symbol: MGAT4A
  Gene Name: mannosyl (alpha-1,3-)-glycoprotein beta-1,4-N-acetylglucosaminyltransferase, isozyme A
  ENST ID: ENST00000495056
  CDS Start-End: 290-424
ctggagcggtttcattgcctacattccgcattggaaaatagaagcaggcacaatgaagggaaaaggccgaggcatcagcgtgtgaagaccgcaaagacgatcccgagtacagttgtgaacagcattgctgctaggctcctcctgcagatcatctgaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaaggtaaggaaaatgactcggaaaatgtgcatgaaatgtactagggtttttgcttggttaaggtgcctaaatgcttaggtcaaataccctggcaatctgcatgttacatgctatctgctggcagtttctttctgatataaaaatgaaacagtattcttggacagaggacacagaatttctaattccagtggggcttgttttgttttcagtttcttataattgtacttggagaaacagatactgatcagtgttttatattctaaaagacagccaagttgaataataaagactttcgttttggca

SEQ ID NO: 151575 - DNA, 2446 bp, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  Uniprot ID: Q9UQ53
  ENST ID: ENST00000292591
  CDS Start-End: 352-1998
cgcggctctcgccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggtccccgcccggccccgggccccccgcccctccccgacccggggccggggcccctgccgccgccgccgccgccttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctcaaa

SEQ ID NO: 151576 - DNA, 3027 bp, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  Uniprot ID: Q9UQ53
  ENST ID: ENST00000337755
  CDS Start-End: 888-2579
ctctggggtctgtgaagccaccaaggatcaaggaatggaagagctgcctgagtgtagagggagttcggtcaggcttcttaaacttggagacttggaaacagaaggccttgtaggccacataggttttcagagactcgcctggcagaggcctggagcgtcctgctgcgtggactgtgggcaccgagccaccaggaggttgttgatctcattcttgctcactggtccctgccagactggtggtgcctctctactgtcgggcagccccacctctgtgctgccccatccacctacagccctcatgcctgggcccagctggaggttctgacaggggccccctggggtggcatgcggacccttcagggtgccccaggcgcagcacaggtctccagagacacaggcaccagggcgttcagagctagtcccctcgctgctgttgactgtccttgagcagccccagggccggtttctcaacctcatttgctcacctgagcaatgaagtgaggtgggctcctggaactgcagcagccaccccccggggccatcgtgaggctaagaatccagtgcagggtgagcaaccagcgaccgctacaaggacagtgaagagctagcaccaggaccttgggtagcccacccgctggagggagcgtgtgctgcaaaaagcaagagtgggctttggaggccaacggatggagcggattcagtctgaggctgttccagcccttgcttaggatccacctacctaggtctggaaatcgtatttccacttcagatgccttctcagaggataaaataacccccggtgggggagagtactggaagagggctaattcccctggttttctccccatgagcattagtgtcagtgtaattttagagtgaccccagctatgtcacgtgtggcaggcacaagaacagatgtcaatgagctattgcagaggtggacacccagatgtgtgcgctggcacactggaggggcccgtagggtggctctagaccgccccctcgtgacggcttgcctaccacctgcaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctcaaa

SEQ ID NO: 151577 - DNA, 1080 bp, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENST ID: ENST00000523108
  CDS Start-End: 481-1080
acttgtttgctgctggagccgcggcgttctcctcgggcccgggccgcgcccgtgggtgctccggaccggactccgcgggcgcagctgtcccgacgctgagctggggacccgtggggttctcggagaggggcagagacccaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaag

SEQ ID NO: 151578 - DNA, 732 bp, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENST ID: ENST00000518867
  CDS Start-End: 1-732
acagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagagtgggaacatcgagcacccggaggacaagctcttcaacacgtctgtggaggtgctgcccttcgacaaccctcagtcagacaaggaggccctgc

SEQ ID NO: 151579 - DNA, 1568 bp, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENST ID: ENST00000518778
  CDS Start-End: 1-1120
ggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctcaaa

SEQ ID NO: 151580 - DNA, 1096 bp, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENST ID: ENST00000520969
  CDS Start-End: 1-722
gtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcgtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattt

SEQ ID NO: 151581 - DNA, 799 bp, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENST ID: ENST00000520918
  CDS Start-End: 5-478
agctatgtcacgtgtggcaggcacaagaacagatgtcaatgagctattgcagaggtggacacccagatgtgtgcgctggcacactggaggggcccgtagggtggctctagaccgccccctcgtgacggcttgcctaccacctgcaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcct

SEQ ID NO: 151582 - DNA, 1686 bp, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENST ID: ENST00000519836
  CDS Start-End: 1-1289
ctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaag

SEQ ID NO: 151583 - DNA, 964 bp, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENST ID: ENST00000520875
  CDS Start-End: 1-964
gttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcggccgggatcaaggtcggggcccacgccatcactgctgtccctcctccgctgcaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgag

SEQ ID NO: 151584 - DNA, 543 bp, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENST ID: ENST00000523329
  CDS Start-End: 1-451
gctgctgctcttctgcctgtgcgccttcctctcgctgtcctggtacgcggcactcagcggccagaaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtaca

SEQ ID NO: 151585 - DNA, 983 bp, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENST ID: ENST00000518980
  CDS Start-End: 1-922
cacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattgcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgccc

SEQ ID NO: 151586 - DNA, 2687 bp, Homo sapiens
  Payload ID: 9839
  Gene Symbol: MGAT2
  Gene Name: mannosyl (alpha-1,6-)-glycoprotein beta-1,2-N-acetylglucosaminyltransferase
  Uniprot ID: Q10469
  ENST ID: ENST00000305386
  CDS Start-End: 475-1818
cggggcagttgcgggttgtcataacggtccccgccggagtgaggcgaggccgcgtcgctcagttctggccgtctagggcccctgtaaggatgagagcgcagaggacgcagggccgctggaggcgcaggtaacgaagctagggtgcggttgggaccgcggctgagctttttccgggacccgtggtgctgaatggagaggacggagacgaagccgagccgcggctcctagcggcggcgccgatgctcgagctgtagctgccaggcgaggatgtgtggagcgcaggcggcgcggggtaaatgagaggtctcgggccccaggacccccggggcccgggatgagttagcgagggcagccgcgggggccagttccgaccgtgacaggccaaggcgacggccgccgcccgcccgccccttccgtgcagaagcagctgctcctttccgcgcccgcccgcctgcgctcccggccctggagaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcgaaaagcccagggaattgacaacgtcctcgtcatctttagccatgacttctggtcgaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcattttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagagaagaggggaaattttatttaaattgcatttattaatctttttatctgaaactttgtacacttttccactttcaaaacctattttaagtacagcaaaatttatttaaaactgtcatagcagtaaaaagtattacgatgaaattgttagggtattaatggaacaaacccagtttcactctcttgacacacttattaggaagggattgcttcactggtttaataatttaaaagttatgtttgttaaacaccctgtcagaacagtcattttcagtattagattcctgtactattgtgttttgagtgtgttttggaaccttcatagaacacactttcttttggaatgtatttgattgataagaaagtttaaacattgttttcacctcaatgtagaaatacagtggttttgtttttttttttcttttagtgctgacaaaataaaatactcatttttgcataaaaaggttcctaatccttttgcagaataagttttgtttactctttataccaaaattcagtgaaggcattctacaagttttgagttagcattacattttaatatttactattgctacattgtataattgagtttgaaataaaacccagcttatgacaatgca

SEQ ID NO: 151587 - DNA, 8144 bp, Homo sapiens
  Payload ID: 9840
  Gene Symbol: MGAT5
  Gene Name: mannosyl (alpha-1,6-)-glycoprotein beta-1,6-N-acetyl-glucosaminyltransferase
  Uniprot ID: Q09328
  ENST ID: ENST00000281923
  CDS Start-End: 146-2371
cagcagaatggaagtgaggaaaggcaaccagctgacacaggagccagagtgagaccagcagactctcacactcaacctacaccatgaatttgtgtctatcttctacgcgttaagagccaaggacaggtgaagttgccagagagcaatggctctcttcactccgtggaagttgtcctctcagaagctgggctttttcctggtgacttttggcttcatttggggtatgatgcttctgcactttaccatccagcagcgaactcagcctgaaagcagctccatgctgcgcgagcagatcctggacctcagcaaaaggtacatcaaggcactggcagaagaaaacaggaatgtggtggatgggccatacgctggagtcatgacagcttatgatctgaagaaaacccttgctgtgttattagataacattttgcagcgcattggcaagttggagtcgaaggtggacaatcttgttgtcaatggcaccggaacaaactcaaccaactccactacagctgttcccagcttggttgcacttgagaaaattaatgtggcagatatcattaacggagctcaagaaaaatgtgtattgcctcctatggacggctaccctcactgtgagggaaagatcaagtggatgaaagacatgtggcgttcagatccctgctacgcagactatggagtggatggatccacctgctctttttttatttacctcagtgaggttgaaaattggtgtcctcatttaccttggagagcaaaaaatccctacgaagaagctgatcataattcattggcggaaattcgtacagattttaatattctctacagtatgatgaaaaagcatgaagaattccggtggatgagactacggatccggcgaatggctgacgcatggatccaagcaatcaagtccctggcagaaaagcagaaccttgaaaagagaaagcggaagaaagtcctcgttcacctgggactcctgaccaaggaatctggatttaagattgcagagacagctttcagtggtggccctcttggtgaattagttcaatggagtgatttaattacatctctgtacttactgggccatgacattaggatttcagcttcactggctgagctcaaggaaatcatgaagaaggttgtaggaaaccgatctggctgcccaactgtaggagacagaattgttgagctcatttacattgatattgtaggacttgctcaattcaagaaaactcttggaccatcctgggttcattaccagtgcatgctccgagtccttgattcatttggtactgaacccgaatttaatcatgcaaattatgcccaatcgaaaggccacaagaccccttggggaaaatggaatctgaaccctcagcagttttataccatgttccctcataccccagacaacagctttctggggtttgtggttgagcagcacctgaactccagtgatatccaccacattaatgaaatcaaaaggcagaaccagtcccttgtgtatggcaaagtggatagcttctggaagaataagaagatctacttggacattattcacacatacatggaagtgcatgcaactgtttatggctccagcacaaagaatattcccagttacgtgaaaaaccatggtatcctcagtggacgggacctgcagttccttcttcgagaaaccaagttgtttgttggacttgggttcccttacgagggcccagctcccctggaagctatcgcaaatggatgtgcttttctgaatcccaagttcaacccacccaaaagcagcaaaaacacagactttttcattggcaagccaactctgagagagctgacatcccagcatccttacgctgaagttttcatcgggcggccacatgtgtggactgttgacctcaacaatcaggaggaagtagaggatgcagtgaaagcaattttaaatcagaagattgagccatacatgccatatgaatttacgtgcgaggggatgctacagagaatcaatgctttcattgaaaaacaggacttctgccatgggcaagtgatgtggccacccctcagcgccctacaggtcaagcttgctgagcccgggcagtcctgcaagcaggtgtgccaggagagccagctcatctgcgagccttctttcttccagcacctcaacaaggacaaggacatgctgaagtacaaggtgacctgccaaagctcagagctggccaaggacatcctggtgccctcctttgaccctaagaataagcactgtgtgtttcaaggtgacctcctgctcttcagctgtgcaggcgcccaccccaggcaccagagggtctgcccctgccgggacttcatcaagggccaggtggctctctgcaaagactgcctatagcagctacctgctcagccctgcaccatgctgctggggaagacagtggccccagccccgtcaggcagggccagggacagaagtcatgcagggactctggcaagagcctgaactttttcgtagaaggttctgaattggcattgcccttgctgcactccgagcaacccagtggagtcttcaccaaaacaaaacaagagcgtatgtcaggccaggagcctggcttgtccctggcacaacatcatttctgtttctcaaggagcaactgtgggaagactgtcactgcagctgctccagggcaaaagaaagtctcaagagtcctttaaaacaaaacaggaggaattgagctgatgggaaagaactctgaatgggaatattcctaaacccattaacttatttattcgggtgggagggaggggaccgcgggagggagaggagggattgatcacaggcttcttttatttccactgttaatcatccaccttcactatactgttgttctgtctgctttgggcagggtgcaggagagagaccgtgtgccgtggggctggtggcctgctcagggacagccatggggacctggcagctcaaaacagatggcagcagaacaaaagaaacttttgctttggaagcacagccaaactccccagggcatcgtcatagatggcacctagagcatgggctgcctcagtcagggggacgtgcctgtgttgtccagagagcccagccagggacgaaaaaggagatgaggcccctttcctccatgtccccatgcccagacacataccttggccgtaatttcttttagaatccctttgggaaggaaatacaggattgagggattttggagtttctggtaaactcaccctccctccagccccgctatgaggaggaaagtagagatgaaagactcacgctgttcatggacttggagaggattatctttgagccaagatttggacaggagtgaagtcggtccttaagaatttgtggcgcgaccggagctgggctcctgacaggtgggcttgtgttgtgtcccctctgatggcaccaaagtccagggaagggggctcttgatgtctgctgggggagtgggggcagctcaggatgaatgcagtgccctgtcctggctactcacctgagggtgtagctcgcaaaggtgggaatctggtgctggcttttccttcaggcaggatcactctgacttgttgagtaatcagtcatcaggttggcctggtcagacacactggaccccaccttccaaaccctggacccccccatgctctgcctttgtataagttcccaccccactgaatcattgctgccatgctctgtacaagtttgtaagtttctgaaaagcccctgacatctccatgctgatgcaagtgagaccccttctgcctaatgtgagcggttggcgtcctccacttggcctctgctgggcgcctcagtcgctcaatgatgtgctctgtgccggggcttccaagcacccttcctgctaacagagggcggcccagtggagcctccgctgggcagaactgatgggcaaggcgtaatggctggtagctttcagaatgtgagggaaaggaagaattccgcttcatggggactagagttagtgtggggcctttaagtctgggaagttacattctgcttctttctcaattgctacacaaatgtgcagccagccttttttcttaggcccactgagatccctgctcagtgcgtctcaattgtatctccagtctaagaggagggtggggggcacccggggcctcctccactccttaggtggcccccaagcacatctgccaggtagagtaccatggggaggcctctgccctgagcatcatcacaggggcgcctccagacctggctgagaatagcctctgcttgggcctaggaagaagggcagaagtccaaaggaaaccttggtgagtgagtgtgtgtgtgtgtgtgtgtgtgtgtgtgtgtgtgtgtgtgtgtgtgtatgagcctgtgcatttcttttaagcaagggcagtttcctgcagtaggagggcagatgactggcatccttgctgtaaggaagagctttttccttgtgaatgggcctcttggctgtaccctagggtgtgggaatttgctagagttccctgacctgcaatccctgggccagtgccgccctctcctgggctcttccaggagcattgaacactgaggatgtcaatgcaagtatctgaccaacagggggagcctgcaggccgagcaaagtttaacccacttagccactgctacttaagcaaggaagctgaaaggtaaccttagccctgccttgtgttccaaaagctgcaaggatcatttgctggctgtccctaagttcaaggcctccctaccttccccttcttttccaagtcacaacccgccctgcccgggccagacagcccagaagaacacttttctgccatttaaaaatccctctttcatcccccccagtccagtattgagtggaagtgcgccggagttccactgacagggcagctgctcttggagcaaacaagcccacactccagttgtttagggcattatctgaagagtcagtgacccctgaatgtgtactggctcccaggcctcctcagacttggcccaggtctagtcagtgatcctggagaggaaactggggagggggcttccaactgccctgcatggaagaggagaggaaggtgcccctgtgtgggctggaagcctgcggaggttttgccattgctgatcttgatagaatcctaaaccgatttatagctgataacagttccatggggagagaaatcctaagttatgattaatgtttttccccgctataatatcttgcctgtttttttggattattttccccattgtgatcctaagctcttaaaaaacttgagggaaaacattcatctaatttactaaaagagaaagctttccattgaaaggtagatactttgaggagtaaaaagacttctttgaatgctggtaaacaccgcatttattttgtgtatgcagtttgatttgcacatgtataaatggagatgcttttcatttttgtttggactgggtttgtgtcactgctcattacagtttgcttttttgtgtgtttgctgtgcgtttggagatattagtcagtttctttagtgatatttgtttccttgatgtgccttttcgtttttctttggggtttttggaatccggatgctgttgaagggcaatagcagactcctccagctaagagacaggacatgttcttgagccactgtagctgttgaagctggacaccagacgctccctataacccccccgccaggccatagcgtgtatgcatgtgcacttccacccacagaggagggtgtgaagccttgagaacctcaagaaagggctggattctgccatacctttgggtctaccttgggactgctggttgccaacgtgtcaaccagcctgtgttccctgccacccacgcacttgctgaggtgtggctgaggcagaatcatgtgaatgggtgcatccaaggagttcagggccctgcttggagaagaaatactttagcatcatgaaagggaaagaacgtgcaccccttttttgtttctttagtgaatgcaagatttaataaaagtgaataatgagcttcccctttgggagtggagcccagtgcagctcactgacagggttgacatcagtatgatgtgttggactgaaactgtatgtctgtaggtaggtgtgtgccttttagggcagaccacggtggccaccccatttctccaaggtggtttacctagcttgtgtatattagacattgccaccctcacctctggccaaaaattcttgatttaaaaagaaaagtctattttgttaacgacaggctctgttgtatgtgttactatcccaagcctggattattttatttatttaaaagtattttaatttccatattggctttattctaatcccatccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtg

SEQ ID NO: 151588 - DNA, 8252 bp, Homo sapiens
  Payload ID: 9840
  Gene Symbol: MGAT5
  Gene Name: mannosyl (alpha-1,6-)-glycoprotein beta-1,6-N-acetyl-glucosaminyltransferase
  Uniprot ID: Q09328
  ENST ID: ENST00000409645
  CDS Start-End: 253-2478
agcccaggtagccgcgccgcaggctcggggcgtcgcgacctcgcgcctcgggccgcgtgggcacggcggccggcgggtgctcccggctgctgctgctgcccaacaaggagcagaatggaagtgaggaaaggcaaccagctgacacaggagccagagtgagaccagcagactctcacactcaacctacaccatgaatttgtgtctatcttctacgcgttaagagccaaggacaggtgaagttgccagagagcaatggctctcttcactccgtggaagttgtcctctcagaagctgggctttttcctggtgacttttggcttcatttggggtatgatgcttctgcactttaccatccagcagcgaactcagcctgaaagcagctccatgctgcgcgagcagatcctggacctcagcaaaaggtacatcaaggcactggcagaagaaaacaggaatgtggtggatgggccatacgctggagtcatgacagcttatgatctgaagaaaacccttgctgtgttattagataacattttgcagcgcattggcaagttggagtcgaaggtggacaatcttgttgtcaatggcaccggaacaaactcaaccaactccactacagctgttcccagcttggttgcacttgagaaaattaatgtggcagatatcattaacggagctcaagaaaaatgtgtattgcctcctatggacggctaccctcactgtgagggaaagatcaagtggatgaaagacatgtggcgttcagatccctgctacgcagactatggagtggatggatccacctgctctttttttatttacctcagtgaggttgaaaattggtgtcctcatttaccttggagagcaaaaaatccctacgaagaagctgatcataattcattggcggaaattcgtacagattttaatattctctacagtatgatgaaaaagcatgaagaattccggtggatgagactacggatccggcgaatggctgacgcatggatccaagcaatcaagtccctggcagaaaagcagaaccttgaaaagagaaagcggaagaaagtcctcgttcacctgggactcctgaccaaggaatctggatttaagattgcagagacagctttcagtggtggccctcttggtgaattagttcaatggagtgatttaattacatctctgtacttactgggccatgacattaggatttcagcttcactggctgagctcaaggaaatcatgaagaaggttgtaggaaaccgatctggctgcccaactgtaggagacagaattgttgagctcatttacattgatattgtaggacttgctcaattcaagaaaactcttggaccatcctgggttcattaccagtgcatgctccgagtccttgattcatttggtactgaacccgaatttaatcatgcaaattatgcccaatcgaaaggccacaagaccccttggggaaaatggaatctgaaccctcagcagttttataccatgttccctcataccccagacaacagctttctggggtttgtggttgagcagcacctgaactccagtgatatccaccacattaatgaaatcaaaaggcagaaccagtcccttgtgtatggcaaagtggatagcttctggaagaataagaagatctacttggacattattcacacatacatggaagtgcatgcaactgtttatggctccagcacaaagaatattcccagttacgtgaaaaaccatggtatcctcagtggacgggacctgcagttccttcttcgagaaaccaagttgtttgttggacttgggttcccttacgagggcccagctcccctggaagctatcgcaaatggatgtgcttttctgaatcccaagttcaacccacccaaaagcagcaaaaacacagactttttcattggcaagccaactctgagagagctgacatcccagcatccttacgctgaagttttcatcgggcggccacatgtgtggactgttgacctcaacaatcaggaggaagtagaggatgcagtgaaagcaattttaaatcagaagattgagccatacatgccatatgaatttacgtgcgaggggatgctacagagaatcaatgctttcattgaaaaacaggacttctgccatgggcaagtgatgtggccacccctcagcgccctacaggtcaagcttgctgagcccgggcagtcctgcaagcaggtgtgccaggagagccagctcatctgcgagccttctttcttccagcacctcaacaaggacaaggacatgctgaagtacaaggtgacctgccaaagctcagagctggccaaggacatcctggtgccctcctttgaccctaagaataagcactgtgtgtttcaaggtgacctcctgctcttcagctgtgcaggcgcccaccccaggcaccagagggtctgcccctgccgggacttcatcaagggccaggtggctctctgcaaagactgcctatagcagctacctgctcagccctgcaccatgctgctggggaagacagtggccccagccccgtcaggcagggccagggacagaagtcatgcagggactctggcaagagcctgaactttttcgtagaaggttctgaattggcattgcccttgctgcactccgagcaacccagtggagtcttcaccaaaacaaaacaagagcgtatgtcaggccaggagcctggcttgtccctggcacaacatcatttctgtttctcaaggagcaactgtgggaagactgtcactgcagctgctccagggcaaaagaaagtctcaagagtcctttaaaacaaaacaggaggaattgagctgatgggaaagaactctgaatgggaatattcctaaacccattaacttatttattcgggtgggagggaggggaccgcgggagggagaggagggattgatcacaggcttcttttatttccactgttaatcatccaccttcactatactgttgttctgtctgctttgggcagggtgcaggagagagaccgtgtgccgtggggctggtggcctgctcagggacagccatggggacctggcagctcaaaacagatggcagcagaacaaaagaaacttttgctttggaagcacagccaaactccccagggcatcgtcatagatggcacctagagcatgggctgcctcagtcagggggacgtgcctgtgttgtccagagagcccagccagggacgaaaaaggagatgaggcccctttcctccatgtccccatgcccagacacataccttggccgtaatttcttttagaatccctttgggaaggaaatacaggattgagggattttggagtttctggtaaactcaccctccctccagccccgctatgaggaggaaagtagagatgaaagactcacgctgttcatggacttggagaggattatctttgagccaagatttggacaggagtgaagtcggtccttaagaatttgtggcgcgaccggagctgggctcctgacaggtgggcttgtgttgtgtcccctctgatggcaccaaagtccagggaagggggctcttgatgtctgctgggggagtgggggcagctcaggatgaatgcagtgccctgtcctggctactcacctgagggtgtagctcgcaaaggtgggaatctggtgctggcttttccttcaggcaggatcactctgacttgttgagtaatcagtcatcaggttggcctggtcagacacactggaccccaccttccaaaccctggacccccccatgctctgcctttgtataagttcccaccccactgaatcattgctgccatgctctgtacaagtttgtaagtttctgaaaagcccctgacatctccatgctgatgcaagtgagaccccttctgcctaatgtgagcggttggcgtcctccacttggcctctgctgggcgcctcagtcgctcaatgatgtgctctgtgccggggcttccaagcacccttcctgctaacagagggcggcccagtggagcctccgctgggcagaactgatgggcaaggcgtaatggctggtagctttcagaatgtgagggaaaggaagaattccgcttcatggggactagagttagtgtggggcctttaagtctgggaagttacattctgcttctttctcaattgctacacaaatgtgcagccagccttttttcttaggcccactgagatccctgctcagtgcgtctcaattgtatctccagtctaagaggagggtggggggcacccggggcctcctccactccttaggtggcccccaagcacatctgccaggtagagtaccatggggaggcctctgccctgagcatcatcacaggggcgcctccagacctggctgagaatagcctctgcttgggcctaggaagaagggcagaagtccaaaggaaaccttggtgagtgagtgtgtgtgtgtgtgtgtgtgtgtgtgtgtgtgtgtgtgtgtgtgtgtatgagcctgtgcatttcttttaagcaagggcagtttcctgcagtaggagggcagatgactggcatccttgctgtaaggaagagctttttccttgtgaatgggcctcttggctgtaccctagggtgtgggaatttgctagagttccctgacctgcaatccctgggccagtgccgccctctcctgggctcttccaggagcattgaacactgaggatgtcaatgcaagtatctgaccaacagggggagcctgcaggccgagcaaagtttaacccacttagccactgctacttaagcaaggaagctgaaaggtaaccttagccctgccttgtgttccaaaagctgcaaggatcatttgctggctgtccctaagttcaaggcctccctaccttccccttcttttccaagtcacaacccgccctgcccgggccagacagcccagaagaacacttttctgccatttaaaaatccctctttcatcccccccagtccagtattgagtggaagtgcgccggagttccactgacagggcagctgctcttggagcaaacaagcccacactccagttgtttagggcattatctgaagagtcagtgacccctgaatgtgtactggctcccaggcctcctcagacttggcccaggtctagtcagtgatcctggagaggaaactggggagggggcttccaactgccctgcatggaagaggagaggaaggtgcccctgtgtgggctggaagcctgcggaggttttgccattgctgatcttgatagaatcctaaaccgatttatagctgataacagttccatggggagagaaatcctaagttatgattaatgtttttccccgctataatatcttgcctgtttttttggattattttccccattgtgatcctaagctcttaaaaaacttgagggaaaacattcatctaatttactaaaagagaaagctttccattgaaaggtagatactttgaggagtaaaaagacttctttgaatgctggtaaacaccgcatttattttgtgtatgcagtttgatttgcacatgtataaatggagatgcttttcatttttgtttggactgggtttgtgtcactgctcattacagtttgcttttttgtgtgtttgctgtgcgtttggagatattagtcagtttctttagtgatatttgtttccttgatgtgccttttcgtttttctttggggtttttggaatccggatgctgttgaagggcaatagcagactcctccagctaagagacaggacatgttcttgagccactgtagctgttgaagctggacaccagacgctccctataacccccccgccaggccatagcgtgtatgcatgtgcacttccacccacagaggagggtgtgaagccttgagaacctcaagaaagggctggattctgccatacctttgggtctaccttgggactgctggttgccaacgtgtcaaccagcctgtgttccctgccacccacgcacttgctgaggtgtggctgaggcagaatcatgtgaatgggtgcatccaaggagttcagggccctgcttggagaagaaatactttagcatcatgaaagggaaagaacgtgcaccccttttttgtttctttagtgaatgcaagatttaataaaagtgaataatgagcttcccctttgggagtggagcccagtgcagctcactgacagggttgacatcagtatgatgtgttggactgaaactgtatgtctgtaggtaggtgtgtgccttttagggcagaccacggtggccaccccatttctccaaggtggtttacctagcttgtgtatattagacattgccaccctcacctctggccaaaaattcttgatttaaaaagaaaagtctattttgttaacgacaggctctgttgtatgtgttactatcccaagcctggattattttatttatttaaaagtattttaatttccatattggctttattctaatcccatccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtga

SEQ ID NO: 151589 - DNA, 4486 bp, Homo sapiens
  Payload ID: 9841
  Gene Symbol: MGAT5B
  Gene Name: mannosyl (alpha-1,6-)-glycoprotein beta-1,6-N-acetyl-glucosaminyltransferase, isozyme B
  Uniprot ID: Q3V5L5
  ENST ID: ENST00000301618
  CDS Start-End: 575-2947
gcggggccggacgccggacaccagagcgcgggcggcggagccagcgggcgagagagcgcgcggcgggcgcgggttgccctcgtcgagagccatgggcgcggcgcggcgcggggctgaggatcggcgcggcccggaggcgctggggaccggggcgcgggcccggggccgcctttagccggcaccgagggcgcggggccggggatgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacaccttcgggacggaacctgcgtacaaccacgaggagtacgccacgctgcacggctaccggaccaactggggctactggaacctcaaccccaagcagttcatgaccatgtttcctcatacccccgacaactccttcatgggcttcgtgtccgaggagctcaacgagacggagaagcggctcatcaaaggcggcaaggccagcaacatggccgtggtgtacggcaaggaggcgagcatctggaaggggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagaagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcactagccacttccgcaggtgctgactcccgcactccctggcattttttgcagacaagggcttgggatggaccctcagccccatggtacgccctgcccagtttccagttgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctcttttttttaaagatttatttcttgaaataataaatattttattgggatgtg

SEQ ID NO: 151590 - DNA, 4053 bp, Homo sapiens
  Payload ID: 9841
  Gene Symbol: MGAT5B
  Gene Name: mannosyl (alpha-1,6-)-glycoprotein beta-1,6-N-acetyl-glucosaminyltransferase, isozyme B
  Uniprot ID: Q3V5L5
  ENST ID: ENST00000428789
  CDS Start-End: 104-2509
gccagcatcttgtagttgagctctctttatcctatagtgggggggccctcctgggtctggagctcagcccccatcctttcattctcccttgcttccttcactcatgcactcattcgtaaaacatttgtgcagccggtacgtggtggagcgtcagggcacgatggcccttcctgccctcctgacccgcctccttcctctccgcaggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacaccttcgggacggaacctgcgtacaaccacgaggagtacgccacgctgcacggctaccggaccaactggggctactggaacctcaaccccaagcagttcatgaccatgtttcctcatacccccgacaactccttcatgggcttcgtgtccgaggagctcaacgagacggagaagcggctcatcaaaggcggcaaggccagcaacatggccgtggtgtacggcaaggaggcgagcatctggaaggggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagaagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcactagccacttccgcaggtgctgactcccgcactccctggcattttttgcagacaagggcttgggatggaccctcagccccatggtacgccctgcccagtttccagttgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctcttttttttaaagatttatttcttgaaataataaatattttattgggatgtgaggtg

SEQ ID NO: 151591 - DNA, 2923 bp, Homo sapiens
  Payload ID: 9841
  Gene Symbol: MGAT5B
  Gene Name: mannosyl (alpha-1,6-)-glycoprotein beta-1,6-N-acetyl-glucosaminyltransferase, isozyme B
  ENST ID: ENST00000565043
  CDS Start-End: 40-1491
cagcccccatcctttcattctcccttgcttccttcactcatgcactcattcgtaaaacatttgtgcagccggtacgtggtggagcgtcagggcacgatggcccttcctgccctcctgacccgcctccttcctctccgcaggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacaccttcgggacggaacctgcgtacaaccacgaggagtacgccacgctgcacggctaccggaccaactggggctactggaacctcaaccccaagcagttcatgaccatgtttcgggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagaagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgag

SEQ ID NO: 151592 - DNA, 4492 bp, Homo sapiens
  Payload ID: 9841
  Gene Symbol: MGAT5B
  Gene Name: mannosyl (alpha-1,6-)-glycoprotein beta-1,6-N-acetyl-glucosaminyltransferase, isozyme B
  Uniprot ID: Q3V5L5
  ENST ID: ENST00000569840
  CDS Start-End: 575-2953
gcggggccggacgccggacaccagagcgcgggcggcggagccagcgggcgagagagcgcgcggcgggcgcgggttgccctcgtcgagagccatgggcgcggcgcggcgcggggctgaggatcggcgcggcccggaggcgctggggaccggggcgcgggcccggggccgcctttagccggcaccgagggcgcggggccggggatgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacaccttcgggacggaacctgcgtacaaccacgaggagtacgccacgctgcacggctaccggaccaactggggctactggaacctcaaccccaagcagttcatgaccatgtttcctcatacccccgacaactccttcatgggcttcgtgtccgaggagctcaacgagacggagaagcggctcatcaaaggcggcaaggccagcaacatggccgtggtgtacggcaaggaggcgagcatctggaagctccaggggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagaagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcactagccacttccgcaggtgctgactcccgcactccctggcattttttgcagacaagggcttgggatggaccctcagccccatggtacgccctgcccagtttccagttgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctcttttttttaaagatttatttcttgaaataataaatattttattgggatgtg

SEQ ID NO: 151593 - DNA, 872 bp, Homo sapiens
  Payload ID: 9841
  Gene Symbol: MGAT5B
  Gene Name: mannosyl (alpha-1,6-)-glycoprotein beta-1,6-N-acetyl-glucosaminyltransferase, isozyme B
  ENST ID: ENST00000565675
  CDS Start-End: 315-647
gcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggtgaggggacgtggggaggaggcacacggagcaggggagcggtggcacctgccactccatccggggtgctgtccgtcatctccttttgtgaatctggagaagatttggaccacactgtggtacagcccagagtgcatttctaccacccaaatttaacaaccgttaacatttggtcacatttgtggcctgttttcctctttaaataaaacgtcacagatgaaaactaaaa

SEQ ID NO: 151594 - DNA, 5062 bp, Homo sapiens
  Payload ID: 9842
  Gene Symbol: MGAT3
  Gene Name: mannosyl (beta-1,4-)-glycoprotein beta-1,4-N-acetylglucosaminyltransferase
  Uniprot ID: Q09327
  ENST ID: ENST00000341184
  CDS Start-End: 216-1817
acggggtggaagtgggggtggggggaggggatcggggccgggccggggccgcgctgcctgcgatgccgggcgcccgccgcagccgctgccgccggagcccgggatggggcgagaggctgcggcggacgccagcatctccccgccggggaccccgggggccgcggagccgccgccgccgctgctgccgccgttgctgagacccagcgggcgatgggatgaagatgagacgctacaagctctttctcatgttctgtatggccggcctgtgcctcatctccttcctgcacttcttcaagaccctgtcctatgtcaccttcccccgagaactggcctccctcagccctaacctggtgtccagctttttctggaacaatgccccggtcacgccccaggccagccccgagccaggaggccctgacctgctgcgtaccccactctactcccactcgcccctgctgcagccgctgccgcccagcaaggcggccgaggagctccaccgggtggacttggtgctgcccgaggacaccaccgagtatttcgtgcgcaccaaggccggcggcgtctgcttcaaacccggcaccaagatgctggagaggccgcccccgggacggccggaggagaagcctgagggggccaacggctcctcggcccggcggccaccccggtacctcctgagcgcccgggagcgcacggggggccgaggcgcccggcgcaagtgggtggagtgcgtgtgcctgcccggctggcacggacccagctgcggcgtgcccactgtggtgcagtactccaacctgcccaccaaggagcggctggtgcccagggaggtgccgcgccgcgtcatcaacgccatcaacgtcaaccacgagttcgacctgctggacgtgcgcttccacgagctgggcgacgtggtggacgcctttgtggtgtgcgagtccaacttcacggcttatggggagccgcggccgctcaagttccgggagatgctgaccaatggcaccttcgagtacatccgccacaaggtgctctatgtcttcctggaccacttcccgcccggcggccggcaggacggctggatcgccgacgactacctgcgcaccttcctcacccaggacggcgtctcgcggctgcgcaacctgcggcccgacgacgtcttcatcattgacgatgcggacgagatcccggcccgtgacggcgtccttttcctcaagctctacgatggctggaccgagcccttcgccttccacatgcgcaagtcgctctacggcttcttctggaagcagccgggcaccctggaggtggtgtcaggctgcacggtggacatgctgcaggcagtgtatgggctggacggcatccgcctgcgccgccgccagtactacaccatgcccaacttcagacagtatgagaaccgcaccggccacatcctggtgcagtggtcgctgggcagccccctgcacttcgccggctggcactgctcctggtgcttcacgcccgagggcatctacttcaagctcgtgtccgcccagaatggcgacttcccacgctggggtgactacgaggacaagcgggacctgaactacatccgcggcctgatccgcaccgggggctggttcgacggcacgcagcaggagtacccgcctgcagaccccagcgagcacatgtatgcgcccaagtacctgctgaagaactacgaccggttccactacctgctggacaacccctaccaggagcccaggagcacggcggcgggcgggtggcgccacaggggtcccgagggaaggccgcccgcccggggcaaactggacgaggcggaagtctagagctgcatgatctgatagggtttgtgacagggcgggggtggcggcggcccctagcgctatctccctgcctcctgccggctccttggttcttgaggggaccaggagtgggtggggagtgggggtgggggtagggtttccctactgaagcccttgtgaatcaagggtcaggcctttgagctcagaaaatatccctcctgttgggagagggcgcaggccgtgacgtctgggtggcccttatgactgccaagactgctgtggccaggaggtgccactggagtgtgcgtggtggtccctgggtagcgggggagggtaggcaggattggggaagagagcctgcaggatctcaccaggcagcctctggggggtggccaggccgggaaaaagcccaccatttggcatccctgggccttgggctccgtgtgggagaccggcctgccaggaggacccagggctctgtaagtagatgcatttgggtccaggaggaagcgtggacacctcgtagggaagagatgaaaaagccacatcctaccaagaggaggtgctgagggatgctttgcagtgtagtcagaagtgctgggccagatggagacagaactccaccccctgccgcaaaggacaggacctggctgccctgggatgctggtgcctgagtctgtctctgtgcacccctcaggctgtcgtgagccaacacaggggcctggagaaccctgaggagctttccttttggttctaaacccggcgttgacgttccttctccctttcacattgctgtcttgtggactgtgcactcagtccttgcaaggccaagagtccagttgtaggtgtggccttgagggggaagtggggaggagaagactgacatgagtcctctgcacggatccgtctctccctccccatcaccccttccttctgacacccagtcccagctgtccactgtcccaggtgcagtcactgttgtgcccttccttggggcaggctggctgggggccagaaaggggccatgaggctgtcttgggcccaaaaagggacaataaggccagttgtatgcttcctgttcctcatagcttgccttggtggggatgtctttgttggagttgattctgagctgctgtgattaggagaccctgaaatacagtggtttaagcaagatggaagcttgtttctaattagtctagattgagatggcccagagctggtagggcagctctgcgtttcttcatacgcaccttccaattctgggtacacagcggctgctccagcgcccaccctcctgtgtgcatccaagcctgggggaagcagaaatagacaagagggcacacccactttttgctaaaggcatgagccagaattggcaggctcacctctgctggcctctcattggctgggactcagtcacatggccacaagcagctgctagggaacctgggaagtgtagtcttcagcggggccgccatgtgcctggcctcaccttgggagttatcttattgatggaggagaagagaatggatatgggggaccagtagcatctctgggagagggggagggagcagcaataactcagtcgtcggatccagctctcattgtcagagtttccggaacagcttgctcctgtttccctcactgtgcagcccagggctgggggcagtgaggagcttgcagctctgtgggaaggggaaacaccccctcccctcggcccctcagacgctacccaatgatgccggtttgcagagttggcctgtggaatggctcatgtttgtgcgtgtgtgtgtgtatatttatgggcatgggtgcatgcttggtgtgtatttgtacatgtctgtattgctgtgtccctgtaaatacatgcttgtgtatggatggaagaggccaggcccaggcctggcctcttcctcgggcctgtggccacacctcctgcagctccccaaaatgactgaggcagaaagcccttggggagcctagaaagcaaagctaaaggggatgcagggtctgtctgtctgtctgtctttcagtctgaggaatgagaatcctgacctgagggctgtgcagctgagagcccactacctccccagcccctctcggccccagccgcatcatcccacctgtcccctcccccccacctccagtggggctttctccagatgtcttatggttgggggtttcctgatgggccaggagaggagggcatcttcttgcgacagcactgtctgggttaagtgcccagtgagggcatggtgtggggagctggcctcagaggagccgctggtgggcaagcgtgaagtgggctgaggggctctgagccactttgctcccatctaggggactgccccccatggaactcctttgaagtcacagcagccttcctttctgtttgctcttggggctgagaggtggctcaaacactcggggtccctatggctctgggtcaatctaggccaggctgcaccccatggacagggagtctcagggctcctgatcatgcccaggccctggcctggggcctccctccttggcagctttcccacccccacgcccctggcatcctcagttgctatgggatgcccctccagggcaccagctcagggctaagcgaaggaagataggagcagctcagagctgccaggctctgccttcctcacagacctggtggggcaggtcctgttcacagcagcaggagtgaaggcctggccatcggtggagagggcagctgtcagagggctgggggccagggcacaggattgaagagtttcacatatcatcacagcatacactgggaatttggtgggggcagaagaacccagggccactccctcaatatgaagggaaaccaagctgaatgtgaccaccggcacactgctgccatgtcccatgtccacctttctccccgggaataactggccctgagacccctagacccaaggaggcctgtccatgccaagcatccgggaagcatggctggccttatccacccatgggtcacgtcggttcccaggggcagcatgggagatctttgggggcaacagggagagtctgggtggggagacgggacttgtccaagcagaaggcaggaccctgggaaatgcataatgtaaggacatcaataatagtattattttttttgtaagggaaaatcaatatgtacattctgaaatcattttctctgtaaatggttggatttcatttcacccttaaagggatgcttaaaggagaagataatattaataataaaaacagctacaaagtctgaa

SEQ ID NO: 151595 - DNA, 552 bp, Homo sapiens
  Payload ID: 9842
  Gene Symbol: MGAT3
  Gene Name: mannosyl (beta-1,4-)-glycoprotein beta-1,4-N-acetylglucosaminyltransferase
  ENST ID: ENST00000418314
  CDS Start-End: 228-552
gtatttggtcgtccagcgggaaacccaaatggaaggaaagaaaaaaaaaaaaaaccatgcatttatagaacctctgccaatggccaggctccatgcagaatgctttgacaccgtggctcagccaggtctcccacaggactgcaaaacagagggtgacatctttcttttagatcggagaagactgaggaccagagaagctaagtaacttgccaaagggcacacagcaaatggagtcttgctcttgtcacccaggttctggagtgcaatggcgtgatcatggctcactgcaacttccgccccctgggttcaagatgaagatgagacgctacaagctctttctcatgttctgtatggccggcctgtgcctcatctccttcctgcacttcttcaagaccctgtcctatgtcaccttcccccgagaactggcctccctcagccctaacctggtgtccagctttttctggaacaatgccccggtcacgccccaggccagccccgagccaggaggccctgacctgctgcgtaccccactctactcccactcgcccctgc

SEQ ID NO: 151596 - DNA, 569 bp, Homo sapiens
  Payload ID: 9842
  Gene Symbol: MGAT3
  Gene Name: mannosyl (beta-1,4-)-glycoprotein beta-1,4-N-acetylglucosaminyltransferase
  ENST ID: ENST00000429402
  CDS Start-End: 87-569
acacctgggctcagcctctagggaggaaactgctgccatagagccttgaaagccaggcagaggggactagacactgtgcctcaaggatgaagatgagacgctacaagctctttctcatgttctgtatggccggcctgtgcctcatctccttcctgcacttcttcaagaccctgtcctatgtcaccttcccccgagaactggcctccctcagccctaacctggtgtccagctttttctggaacaatgccccggtcacgccccaggccagccccgagccaggaggccctgacctgctgcgtaccccactctactcccactcgcccctgctgcagccgctgccgcccagcaaggcggccgaggagctccaccgggtggacttggtgctgcccgaggacaccaccgagtatttcgtgcgcaccaaggccggcggcgtctgcttcaaacccggcaccaagatgctggagaggccgcccccgggacggccggaggagaagcctgagggggccaacggctcctcggcccggcggccaccccggtacctcctgagcgcccgggagcgcacggggggc

SEQ ID NO: 151597 - DNA, 2895 bp, Homo sapiens
  Payload ID: 9843
  Gene Symbol: MOGS
  Gene Name: mannosyl-oligosaccharide glucosidase
  Uniprot ID: Q13724
  ENST ID: ENST00000233616
  CDS Start-End: 164-2677
acttccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaacattttgaactcta

SEQ ID NO: 151598 - DNA, 2668 bp, Homo sapiens
  Payload ID: 9843
  Gene Symbol: MOGS
  Gene Name: mannosyl-oligosaccharide glucosidase
  ENST ID: ENST00000409065
  CDS Start-End: 139-768
ggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 151599 - DNA, 2568 bp, Homo sapiens
  Payload ID: 9843
  Gene Symbol: MOGS
  Gene Name: mannosyl-oligosaccharide glucosidase
  Uniprot ID: Q13724
  ENST ID: ENST00000452063
  CDS Start-End: 156-2351
acttccggcgggaggcggaggcggaggcgcaggcgctggctggcaggtgtcgctaaccggacggtggtcgccagggcgagaggcgggagccggagagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaacattttgaactct

SEQ ID NO: 151600 - DNA, 520 bp, Homo sapiens
  Payload ID: 9843
  Gene Symbol: MOGS
  Gene Name: mannosyl-oligosaccharide glucosidase
  ENST ID: ENST00000414701
  CDS Start-End: 86-520
gaggcggaggcgcaggcgctggctggcaggtgtcgctaaccggacggtggtcgccagggcgagaggcgggagccggagaggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctgg

SEQ ID NO: 151601 - DNA, 1616 bp, Homo sapiens
  Payload ID: 9843
  Gene Symbol: MOGS
  Gene Name: mannosyl-oligosaccharide glucosidase
  ENST ID: ENST00000448666
  CDS Start-End: 142-1616
gcggaggcggaggcgcaggcgctggctggcaggtgtcgctaaccggacggtggtcgccagggcgagaggcgggagccggagagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacct

SEQ ID NO: 151602 - DNA, 2220 bp, Homo sapiens
  Payload ID: 9844
  Gene Symbol: MANSC1
  Gene Name: MANSC domain containing 1
  Uniprot ID: Q9H8J5
  ENST ID: ENST00000396349
  CDS Start-End: 265-1458
cttgctaaccacaaaacccgccaggccggtgcgggagctgcggagcatccgctgcggtcctcgccgagacccccgcgcggattcgccggtccttcccgcgggcgcgacagagctgtcctcgcacctggatggcagcaggggcgccggggtcctctcgacgccagagagaaatctcatcatctgtgcagccttcttaaagcaaactaagaccagagggaggattatccttgacctttgaagaccaaaactaaactgaaatttaaaatgttcttcgggggagaagggagcttgacttacactttgggaatcagaggcaatgagcccgtatatacttcaactcaagaagactgcattaattcttgctgttcaacaaaaaacatatcaggggacaaagcatgtaacttgatgatcttcgacactcgaaaaacagctagacaacccaactgctacctatttttctgtcccaacgaggaagcctgtccattgaaaccagcaaaaggacttatgagttacaggataattacagattttccatctttgaccagaaatttgccaagccaagagttaccccaggaagattctctcttacatggccaattttcacaagcagtcactcccctagcccatcatcacacagattattcaaagcccaccgatatctcatggagagacacactttctcagaagtttggatcctcagatcacttggagaaactatttaagatggatgaagcaagtgcccagctccttgcttataaggaaaaaggccattctcagagttcacaattttcctctgatcaagaaatagctcatctgctgcctgaaaatgtgagtgcgctcccagctacggtggcagttgcttctccacataccacctcggctactccaaagcccgccacccttctacccaccaatgcttcagtgacaccttctgggacttcccagccacagctggccaccacagctccacctgtaaccactgtcacttctcagcctcccacgaccctcatttctacagtttttacacgggctgcggctacactccaagcaatggctacaacagcagttctgactaccacctttcaggcacctacggactcgaaaggcagcttagaaaccataccgtttacagaaatctccaacctaactttgaacacagggaatgtgtataaccctactgcactttctatgtcaaatgtggagtcttccactatgaataaaactgcttcctgggaaggtagggaggccagtccaggcagttcctcccagggcagtgttccagaaaatcagtacggccttccatttgaaaaatggcttcttatcgggtccctgctctttggtgtcctgttcctggtgataggcctcgtcctcctgggtagaatcctctcggaatcactccgcaggaaacgttactcaagactggattatttgatcaatgggatctatgtggacatctaaggatggaactcggtgtctcttaattcatttagtaaccagaagcccaaatgcaatgagtttctgctgacttgctagtcttagcaggaggttgtattttgaagacaggaaaatgcccccttctgctttccttttttttttttggagacagagtcttgctttgttgcccaggctggagtgcagtagcacgatctcggctctcaccgcaacctccgtctcctgggttcaagcgattctcctgcctcagcctcctaagtatctgggattacaggcatgtgccaccacacctgggtgatttttgtatttttagtagagacggggtttcaccatgttggtcaggctggtctcaaactcctgacctagtgatccaccctcctcggcctcccaaagtgctgggattacaggcatgagccaccacagctggcccccttctgttttatgtttggtttttgagaaggaatgaagtgggaaccaaattaggtaattttgggtaatctgtctctaaaatattagctaaaaacaaagctctatgtaaagtaataaagtataattgccatataaatttcaaaattcaactggcttttatgcaaagaaacaggttaggacatctaggttccaattcattcacattcttggttccagataaaatcaactgtttatatcaatttctaatggatttgcttttctttttatatggattcctttaaaacttattccagatgtagttccttccaattaaatatttgaataaatcttttgttactc

SEQ ID NO: 151603 - DNA, 496 bp, Homo sapiens
  Payload ID: 9844
  Gene Symbol: MANSC1
  Gene Name: MANSC domain containing 1
  ENST ID: ENST00000543314
  CDS Start-End: 325-496
acaaaacccgccaggccggtgcgggagctgcggagcatccgctgcggtcctcgccgagacccccgcgcggattcgccggtccttcccgcgggcgcgacagagctgtcctcgcacctggatggcagcaggggcgccggggtcctctcgacgccagatttttgtgtggacataagttttcaattcatttgagtgaatacataggaggacaattgctgaattgtatgagagaaatctcatcatctgtgcagccttcttaaagcaaactaagaccagagggaggattatccttgacctttgaagaccaaaactaaactgaaatttaaaatgttcttcgggggagaagggagcttgacttacactttggtaataatttgcttcctgacactaaggctgtctgctagtcagaattgcctcaaaaagagtctagaagatgttgtcattgacatccagtcatctctttctaagggaatcagaggcaatgagcccgtatatactt

SEQ ID NO: 151604 - DNA, 5831 bp, Homo sapiens
  Payload ID: 9844
  Gene Symbol: MANSC1
  Gene Name: MANSC domain containing 1
  Uniprot ID: Q9H8J5
  ENST ID: ENST00000535902
  CDS Start-End: 565-1860
ttttaacttgcgcgggccgcgaggcaaggctcacctgcagaccctcgggccaccagcagggaggcacgcactccccctcgcagcgcgcccagcccggggtcagcggtgtggctgagctgggggggagcgcggggcggtggggggagccacctccctgcggggctcagcgctggggccgggagcccggagcctccgcggggagggacgcgctaatgttgccgggaagcagctccgggttgcagggcaggaacgtgcccttcccccgcggcaaacttgccgtcgctgcgacggaagcaggaacttgctaaccacaaaacccgccaggccggtgcgggagctgcggagcatccgctgcggtcctcgccgagacccccgcgcggattcgccggtccttcccgcgggcgcgacagagctgtcctcgcacctggatggcagcaggggcgccggggtcctctcgacgccagagagaaatctcatcatctgtgcagccttcttaaagcaaactaagaccagagggaggattatccttgacctttgaagaccaaaactaaactgaaatttaaaatgttcttcgggggagaagggagcttgacttacactttggtaataatttgcttcctgacactaaggctgtctgctagtcagaattgcctcaaaaagagtctagaagatgttgtcattgacatccagtcatctctttctaagggaatcagaggcaatgagcccgtatatacttcaactcaagaagactgcattaattcttgctgttcaacaaaaaacatatcaggggacaaagcatgtaacttgatgatcttcgacactcgaaaaacagctagacaacccaactgctacctatttttctgtcccaacgaggaagcctgtccattgaaaccagcaaaaggacttatgagttacaggataattacagattttccatctttgaccagaaatttgccaagccaagagttaccccaggaagattctctcttacatggccaattttcacaagcagtcactcccctagcccatcatcacacagattattcaaagcccaccgatatctcatggagagacacactttctcagaagtttggatcctcagatcacttggagaaactatttaagatggatgaagcaagtgcccagctccttgcttataaggaaaaaggccattctcagagttcacaattttcctctgatcaagaaatagctcatctgctgcctgaaaatgtgagtgcgctcccagctacggtggcagttgcttctccacataccacctcggctactccaaagcccgccacccttctacccaccaatgcttcagtgacaccttctgggacttcccagccacagctggccaccacagctccacctgtaaccactgtcacttctcagcctcccacgaccctcatttctacagtttttacacgggctgcggctacactccaagcaatggctacaacagcagttctgactaccacctttcaggcacctacggactcgaaaggcagcttagaaaccataccgtttacagaaatctccaacctaactttgaacacagggaatgtgtataaccctactgcactttctatgtcaaatgtggagtcttccactatgaataaaactgcttcctgggaaggtagggaggccagtccaggcagttcctcccagggcagtgttccagaaaatcagtacggccttccatttgaaaaatggcttcttatcgggtccctgctctttggtgtcctgttcctggtgataggcctcgtcctcctgggtagaatcctctcggaatcactccgcaggaaacgttactcaagactggattatttgatcaatgggatctatgtggacatctaaggatggaactcggtgtctcttaattcatttagtaaccagaagcccaaatgcaatgagtttctgctgacttgctagtcttagcaggaggttgtattttgaagacaggaaaatgcccccttctgctttccttttttttttttggagacagagtcttgctttgttgcccaggctggagtgcagtagcacgatctcggctctcaccgcaacctccgtctcctgggttcaagcgattctcctgcctcagcctcctaagtatctgggattacaggcatgtgccaccacacctgggtgatttttgtatttttagtagagacggggtttcaccatgttggtcaggctggtctcaaactcctgacctagtgatccaccctcctcggcctcccaaagtgctgggattacaggcatgagccaccacagctggcccccttctgttttatgtttggtttttgagaaggaatgaagtgggaaccaaattaggtaattttgggtaatctgtctctaaaatattagctaaaaacaaagctctatgtaaagtaataaagtataattgccatataaatttcaaaattcaactggcttttatgcaaagaaacaggttaggacatctaggttccaattcattcacattcttggttccagataaaatcaactgtttatatcaatttctaatggatttgcttttctttttatatggattcctttaaaacttattccagatgtagttccttccaattaaatatttgaataaatcttttgttactcagtagtgttctcataagtagcatgtccagctggataactttccatttatttccactagcaaaatgattatgtggtgaaaatatgcgttccacgttaaaatgacaaccccccctttttcccatcagtgagcaaagagcttcacttgggagaatctagcggaatgttagcccacatggagacaatgataagtcagttctgataaatggccatatccacttgggatctgttctagttaacttgtgtgtgtgtgtgtgtgtgtgtgtgtgtgtgtgtgtgtgtgacagagtcttgctctgtcacccaggctagagtgcagtggcgcgatctcggctcactgccagctccgcctcctgggttcccgccattctcctgcctcagcctcccaagtagctgggactacaggcgcccgccaacacgcccagctaattttttatatttttagtaaagacggggtttcactgtgttagtcaggatggtctcgatctcctgaccttgtgatccgcccgcctcggcctcccaaagtgctgggattacaggcgtgagccaccgtgcccggcctctagttaactttttaaagaagtattatagacattttctaaacttgtactaagttaaaaatgtaccactattattttatatccttacttaaattgaccagcaatcagtctaagcttaatttagaacaacattggaaataataactagcacaggccaggcgcggtggctcacgcctgtaatcccagcactttgggaggccgagatgggcaaatcacgaggtcaggagatcgagaccatcctggctaacacggtgaaaccccgcctctactaaaaatacaaaaaattagccgggcgtggtggcgggcgcctgtagttccagctacttgggaggctgaggcaggagagtagtttgaatccaggaggcggaggttgcggtgagccagattgcaccattgcgctccagcctgggcaacagagccagactccgtctcaaaaataataataataataactagcactaacatgatgctacaatttttactggttaccaattaaaatttctgagaaaggcttttaataaagttttccagacaagttataggtgaggtaacaaagagtccagaagtcccctgggtcagtttgatacctctttcctctggacttcaatttgcttatctgcaaaacaggaaatttgatcccttccaagtgtcaccagagtttttaaagataaaaatggaattcagatgcgaacttaatacagtgagcactagagggcagtagctggttaataagtacagcaattaagacaaatgcaggaaatgacagaaaaggcttttcttctccttcctcctcacctcttccttcctcctcacctccttcccctctgctcttctggtacccctcccccatttccctggtttacactaagttcataaagtacattaagaggaaagctggtctattgaaaatactacttttcttatattttccaacttaacagcttgacacaaatctccaaggggtttacataagctttaagtaggctgaataaataaaaccttgagtcaatttaacttaacaagtatttattgaatatccacatgtaggccagaatcagattagtaaccaggtgccttggaattttaaaatttctcctctctttattaatggatttagcgagtggaaatcaggctttctgtgatggtttataaaggtattttcctggctctcttggagttctctgtccaccttgctgcagtctttgttgtgatggggagaccacatgggagcggtccagatgagtgatgctacgggcccaaactgttagtggccgtgaggatataggttgtaggggacatctggagtggaaagagtgctcttctcacacagctctctctacttactgcccctaggatggtgggtgcaactgtggcaagggcagtcagggtaggggaatcccttagaggaattcagcagtgactagtctggttagcctttcccacaaggcccattgagttatgagccccctcctttggtttgtagaaagagaaggtagcagcctagaacaggtgagaagatgaggtaggtccttctgctcaaacatcctctctccgtattttaccaacacgatactgacctaggttaaaaagctactcttggccaggcgtggtggctcacgcctgtaatcccagcactttgggagtccaaggtgggtggatcacctgaggtcaggagttctagaccagcctggccaacatggtgaaaccccatctctacagaaatacaaaaattagccaggcatggtggcagacacctgtaatcccagctacttgggaggctgaggtaggataattgcttgaggccgggagggggcggttgcagtgagccaagatcgctccattgcactccagcctaggcgacagagcaagactctatctcaaaaaaataaaataaaataaaataaaaataagctactcttagccaggcacatagtggctcacatctgtaatctcagccctttgggagactgaggtgggaggatcacttgagcccaggaggtcgaggctgcagtgagccatgatcacgccactgcactccagcctgggcgacagaacgagagcccatctcaaaaaaaaaaacaaaacaacaacaacaaaaaaaaaactaaaaaactcttaaaaaacctgaggactcctggatgaatactgttatgtgcctgtttctcaattacccctggcctgagtgaggaacttttggaactctttggctcccagactgtggtgggcactaccggtcagctgcccagcagccagccctagtcccacttctgcctcatttgttacaggttggaagtgccaggttcagggatgggcctgtgacccaagttttagctgaaaggaaacctactagggacttctaggagagattttcttgcttgtaaagggaaggctgcacaaggagaaaagccctttctaaccacatccccttatttcatgcttgggatgctgaccatgtgaagacttggttgttggagctgtggtggcctccctgccatgatgaggggagaaggcactgccacactgagcgtggcagtgggtacaggaagagtccagtctccgggatgccttggttaattgacaggacaaaccctggaactgccaacttccatcttgttctgtaataataaatctctaatatttgtaccactttca

SEQ ID NO: 151605 - DNA, 1501 bp, Homo sapiens
  Payload ID: 9844
  Gene Symbol: MANSC1
  Gene Name: MANSC domain containing 1
  ENST ID: ENST00000545735
  CDS Start-End: 135-1187
aaaatgaacaaaggtgtttgtgttggactccataataagtgaagtttttcctacttgccctactctttagaaaatcgcatttcaaaatcatgcttatgaaacctttcattgcaggggacaaagcatgtaacttgatgatcttcgacactcgaaaaacagctagacaacccaactgctacctatttttctgtcccaacgaggaagcctgtccattgaaaccagcaaaaggacttatgagttacaggataattacagattttccatctttgaccagaaatttgccaagccaagagttaccccaggaagattctctcttacatggccaattttcacaagcagtcactcccctagcccatcatcacacagattattcaaagcccaccgatatctcatggagagacacactttctcagaagtttggatcctcagatcacttggagaaactatttaagatggatgaagcaagtgcccagctccttgcttataaggaaaaaggccattctcagagttcacaattttcctctgatcaagaaatagctcatctgctgcctgaaaatgtgagtgcgctcccagctacggtggcagttgcttctccacataccacctcggctactccaaagcccgccacccttctacccaccaatgcttcagtgacaccttctgggacttcccagccacagctggccaccacagctccacctgtaaccactgtcacttctcagcctcccacgaccctcatttctacagtttttacacgggctgcggctacactccaagcaatggctacaacagcagttctgactaccacctttcaggcacctacggactcgaaaggcagcttagaaaccataccgtttacagaaatctccaacctaactttgaacacagggaatgtgtataaccctactgcactttctatgtcaaatgtggagtcttccactatgaataaaactgcttcctgggaaggtagggaggccagtccaggcagttcctcccagggcagtgttccagaaaatcagtacggccttccatttgaaaaatggcttcttatcgggtccctgctctttggtgtcctgttcctggtgataggcctcgtcctcctgggtagaatcctctcggaatcactccgcaggaaacgttactcaagactggattatttgatcaatgggatctatgtggacatctaaggatggaactcggtgtctcttaattcatttagtaaccagaagcccaaatgcaatgagtttctgctgacttgctagtcttagcaggaggttgtattttgaagacaggaaaatgcccccttctgctttccttttttttttttggagacagagtcttgctttgttgcccaggctggagtgcagtagcacgatctcggctctcaccgcaacctccgtctcctgggttcaagcgattctcctgcctcagcctcctaagtatctgggattacaggcatgtgccaccacacctgggtgatttttgtatttttagtagagac

SEQ ID NO: 151606 - DNA, 496 bp, Homo sapiens; identical to SEQ ID NO: 151603
  Payload ID: 9844
  Gene Symbol: MANSC1
  Gene Name: MANSC domain containing 1
  ENST ID: ENST00000628134
  CDS Start-End: 325-496

SEQ ID NO: 151607 - DNA, 1501 bp, Homo sapiens; identical to SEQ ID NO: 151605
  Payload ID: 9844
  Gene Symbol: MANSC1
  Gene Name: MANSC domain containing 1
  ENST ID: ENST00000631077
  CDS Start-End: 135-1187

SEQ ID NO: 151608 - DNA, 2220 bp, Homo sapiens; identical to SEQ ID NO: 151602
  Payload ID: 9844
  Gene Symbol: MANSC1
  Gene Name: MANSC domain containing 1
  Uniprot ID: Q9H8J5
  ENST ID: ENST00000626912
  CDS Start-End: 265-1458

SEQ ID NO: 151609 - DNA, 5831 bp, Homo sapiens; identical to SEQ ID NO: 151604
  Payload ID: 9844
  Gene Symbol: MANSC1
  Gene Name: MANSC domain containing 1
  Uniprot ID: Q9H8J5
  ENST ID: ENST00000629245
  CDS Start-End: 565-1860

SEQ ID NO: 151610 - DNA, 1023 bp, Homo sapiens
  Payload ID: 9845
  Gene Symbol: MANSC4
  Gene Name: MANSC domain containing 4
  Uniprot ID: A6NHS7
  ENST ID: ENST00000381273
  CDS Start-End: 1-1023
atgcatgtggcagaggtagcagtgaacgtgatattgctcctaagcatggggtggacatcagactctctctgctcacccacaattttttacagagactgctggatccgtcgcttcccaggtcttctaatcaatctggaggagtctcagaagctgggagcccagttcttgaagtattattctgaaagcactggccagaagtgcagtaggagctgctgtcttcggaaggatgtttcctgtaacctggctgtcttctaccacagtcctattcatgacaatatcaactgcctccatgttcactgcccaacactggagagctgcatattagagcctggaaccagtgccattttgtacaacataacagacggtatagatccggatttgctggtttttgaacaatctcccacatatctaaatactcgttcttcatccaatagatgggacagactaaggattctaaaagctatgaatttagataaacaaaccaccacgataaatggtatgctgccatccacagaggctccatcctcaaccacgcatcaagatttggttgtaaacacaaacagtaccagttattctaaggaattaaccacagatttttgggcaagatttacttccctgaatgagtccattaccacaaagataaataaggtgtcaccaagtactgatttcatcagcaatccagataataagactatttctcctttctttgaacccatagacacaaaactttctcatatgcctgttccacctggactcaacagtagcaaacaattactaaacaaaaccaaaggatacaatagcagaaaccacacatctgcaaatgaagatgaggtatctgtgacttcaaagacttggctggtttctgtggccctttgcacctctgtcatctttctcggctgttgtatagtcatcctggcatctggatgctgtggaaagcagcagggccagtataaaccaggacagagaaaatcaggatccttgcaaattaaaaaccgtaaccatatgaaggagaactcttcatag

SEQ ID NO: 151611 - DNA, 2422 bp, Homo sapiens
  Payload ID: 9846
  Gene Symbol: MKNK1
  Gene Name: MAP kinase interacting serine/threonine kinase 1
  ENST ID: ENST00000342571
  CDS Start-End: 83-421
cagaaacaactctccaagttccatttccaaggaaagtcttaaccatttgtcccttctggcgtaccctctttcattgaaatccatgcagaatataccagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattcta

SEQ ID NO: 151612 - DNA, 2612 bp, Homo sapiens
  Payload ID: 9846
  Gene Symbol: MKNK1
  Gene Name: MAP kinase interacting serine/threonine kinase 1
  ENST ID: ENST00000341183
  CDS Start-End: 456-1445
tctctgatcgggcccaccccctggatctagcaccgcctcttccgcgttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggcct

SEQ ID NO: 151613 - DNA, 2618 bp, Homo sapiens
  Payload ID: 9846
  Gene Symbol: MKNK1
  Gene Name: MAP kinase interacting serine/threonine kinase 1
  Uniprot ID: Q9BUB5
  ENST ID: ENST00000371945
  CDS Start-End: 188-1462
gcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattct

SEQ ID NO: 151614 - DNA, 2719 bp, Homo sapiens
  Payload ID: 9846
  Gene Symbol: MKNK1
  Gene Name: MAP kinase interacting serine/threonine kinase 1
  Uniprot ID: Q9BUB5
  ENST ID: ENST00000371946
  CDS Start-End: 165-1562
gcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaagacaaagtctctctctgtcacctaggctggagtgctatggcgccatcagggctcactgcagccccaacctccctgggctccagtgatcctcccacctcagcctcccaagtagctgggactacaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattcta

SEQ ID NO: 151615 - DNA, 1270 bp, Homo sapiens
  Payload ID: 9846
  Gene Symbol: MKNK1
  Gene Name: MAP kinase interacting serine/threonine kinase 1
  Uniprot ID: Q9BUB5
  ENST ID: ENST00000428112
  CDS Start-End: 164-1207
ttccgcgttctcggaggagcgatctgcaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcagggggaacagcagcacaatggacctgacgctcttcgcagctgaggccatcgcccttaaccgccagctatctcagcacgaagagaacgaactagcagaggagccaga

SEQ ID NO: 151616 - DNA, 580 bp, Homo sapiens
  Payload ID: 9846
  Gene Symbol: MKNK1
  Gene Name: MAP kinase interacting serine/threonine kinase 1
  ENST ID: ENST00000532783
  CDS Start-End: 68-580
actgggcctgcggtgccgatgagaaaatagatgcagacacgggttgccactggactgcattcaagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaag

SEQ ID NO: 151617 - DNA, 494 bp, Homo sapiens
  Payload ID: 9846
  Gene Symbol: MKNK1
  Gene Name: MAP kinase interacting serine/threonine kinase 1
  ENST ID: ENST00000532110
  CDS Start-End: 117-494
ctcttgcctgtgagacttggacttggccactaagagagagagcccagctcatttctctaaaaacgtggatagcagaggagtgcctcgctctgtcacccaggttggagtgcagtggcatgatcttgggtcattgcagcctcgacctcctgggctcaagcaatcctcccacctcagcctcccaagcagctacaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttgga

SEQ ID NO: 151618 - DNA, 540 bp, Homo sapiens
  Payload ID: 9846
  Gene Symbol: MKNK1
  Gene Name: MAP kinase interacting serine/threonine kinase 1
  ENST ID: ENST00000474868
  CDS Start-End: 116-229
atggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagtttcagaaacaactctccaagttccatttccaaggaaagtcttaaccatttgtcccttctggcgtaccctctttcattgaaatccatgcagaatataccagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaagtgagtgtctcagctgaatgccaggctttactttgcaaatagtcattcctagctcatcttgaaccaaataaatgttatattccataagaa

SEQ ID NO: 151619 - DNA, 540 bp, Homo sapiens
  Payload ID: 9846
  Gene Symbol: MKNK1
  Gene Name: MAP kinase interacting serine/threonine kinase 1
  ENST ID: ENST00000528237
  CDS Start-End: 112-540
aagaattcctaggccaagggaagcagtttcagaaacaactctccaagttccatttccaaggaaagtcttaaccatttgtcccttctggcgtaccctctttcattgaaatccatgcagaatataccagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccga

SEQ ID NO: 151620 - DNA, 1557 bp, Homo sapiens
  Payload ID: 9846
  Gene Symbol: MKNK1
  Gene Name: MAP kinase interacting serine/threonine kinase 1
  ENST ID: ENST00000528077
  CDS Start-End: 219-575
ctagcaccgcctcttccgcgttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcagggggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaa

SEQ ID NO: 151621 - DNA, 567 bp, Homo sapiens
  Payload ID: 9846
  Gene Symbol: MKNK1
  Gene Name: MAP kinase interacting serine/threonine kinase 1
  ENST ID: ENST00000531769
  CDS Start-End: 268-567
gcaggagggcagccgcggccggcaggacaggcagacggacaggctgacaggagagagaacaggcactgcgggacctgcaggagaaaggcgatcctgtggctgggaatgtgaccccacggccagaagaggacccgtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcag

SEQ ID NO: 151622 - DNA, 682 bp, Homo sapiens
  Payload ID: 9846
  Gene Symbol: MKNK1
  Gene Name: MAP kinase interacting serine/threonine kinase 1
  ENST ID: ENST00000526513
  CDS Start-End: 175-357
aggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatgtgattcttccctcagctattcctggaggggctgctgagagatagaactatataagaggaagagagaaacaccaaaggccatggccgcaaatgaaacttcagtctcctatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatctt

SEQ ID NO: 151623 - DNA, 1121 bp, Homo sapiens
  Payload ID: 9846
  Gene Symbol: MKNK1
  Gene Name: MAP kinase interacting serine/threonine kinase 1
  ENST ID: ENST00000531355
  CDS Start-End: 188-358
accccctggatctagcaccgcctcttccgcgttctcggaggagcgatctgcaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagtgtggcctcaggaggaatcttttgtacctagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgca

SEQ ID NO: 151624 - DNA, 464 bp, Homo sapiens
  Payload ID: 9846
  Gene Symbol: MKNK1
  Gene Name: MAP kinase interacting serine/threonine kinase 1
  ENST ID: ENST00000465783
  CDS Start-End: 135-410
gtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaagtgagtgtctcagctgaatgccaggctttactttgcaaatagtcattcctagctcatcttgaaccaaataaatgttatattccataagaatgggga

SEQ ID NO: 151625 - DNA, 786 bp, Homo sapiens
  Payload ID: 9846
  Gene Symbol: MKNK1
  Gene Name: MAP kinase interacting serine/threonine kinase 1
  ENST ID: ENST00000524749
  CDS Start-End: 1-257
ccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggg

SEQ ID NO: 151626 - DNA, 530 bp, Homo sapiens
  Payload ID: 9846
  Gene Symbol: MKNK1
  Gene Name: MAP kinase interacting serine/threonine kinase 1
  ENST ID: ENST00000529170
  CDS Start-End: 226-530
ttccgcgttctcggaggagcgatctgcaggtaggggtgcgcgcgaccgctccccggcgggagccagcgaaggtaaaagcgagacctgcgaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtca

SEQ ID NO: 151627 - DNA, 738 bp, Homo sapiens
  Payload ID: 9846
  Gene Symbol: MKNK1
  Gene Name: MAP kinase interacting serine/threonine kinase 1
  ENST ID: ENST00000496619
  CDS Start-End: 203-738
tctctgatcgggcccaccccctggatctagcaccgcctcttccgcgttctcggaggagcgatctgcaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtga

SEQ ID NO: 151628 - DNA, 3774 bp, Homo sapiens
  Payload ID: 9847
  Gene Symbol: MKNK2
  Gene Name: MAP kinase interacting serine/threonine kinase 2
  Uniprot ID: Q9HBH9
  ENST ID: ENST00000250896
  CDS Start-End: 246-1643
cggctcctctcagcggcggtggcccaggtagaggggtccgcgctggcggcggcggcggcgctgttccccgcgcggtccgcggagcggggtccgggctgcgcgacgtggggcggcggcggcactgcggccccggcccaagcccgaccccgggtcccctcctcggccgccccccgcccggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggttttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttttttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtc

SEQ ID NO: 151629 - DNA, 1744 bp, Homo sapiens
  Payload ID: 9847
  Gene Symbol: MKNK2
  Gene Name: MAP kinase interacting serine/threonine kinase 2
  Uniprot ID: Q9HBH9
  ENST ID: ENST00000309340
  CDS Start-End: 226-1470
ggcccaggtagaggggtccgcgctggcggcggcggcggcgctgttccccgcgcggtccgcggagcggggtccgggctgcgcgacgtggggcggcggcggcactgcggccccggcccaagcccgaccccgggtcccctcctcggccgccccccgcccggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgctgtgtg

SEQ ID NO: 151630 - DNA, 631 bp, Homo sapiens
  Payload ID: 9847
  Gene Symbol: MKNK2
  Gene Name: MAP kinase interacting serine/threonine kinase 2
  ENST ID: ENST00000591588
  CDS Start-End: 67-456
acgtaatgctgggaaaccccggctgacgcgcccctcccccgcccgcagtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggtaaggcccgcaggggtgctcgggacccctgagtccagggggcggggtttccaggttaagacatttgtgaaagacccggagaactgctttggggtcggggaggcaggcaagcctggtgactcagtgaagctcccggtggggccctggtgctcagaggagccccagggtgggggctggga

SEQ ID NO: 151631 - DNA, 2413 bp, Homo sapiens
  Payload ID: 9847
  Gene Symbol: MKNK2
  Gene Name: MAP kinase interacting serine/threonine kinase 2
  ENST ID: ENST00000588014
  CDS Start-End: 1-531
aacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggtaaggcccgcaggggtgctcgggacccctgagtccagggggcggggtttccaggttaagacatttgtgaaagacccggagaactgctttggggtcggggaggcaggcaagcctggtgactcagtgaagctcccggtggggccctggtgctcagaggagccccagggtgggggctgggaggggggcatgaagccccttcccccagggccttcacagaccccaggggtcccctgaggggtgcctcttggtgaccacctacccccaccccgtttcccaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggttttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaa

SEQ ID NO: 151632 - DNA, 1503 bp, Homo sapiens
  Payload ID: 9847
  Gene Symbol: MKNK2
  Gene Name: MAP kinase interacting serine/threonine kinase 2
  ENST ID: ENST00000586828
  CDS Start-End: 3-251
agatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggttttttttttcctgtttccacccctccccgttat

SEQ ID NO: 151633 - DNA, 875 bp, Homo sapiens
  Payload ID: 9847
  Gene Symbol: MKNK2
  Gene Name: MAP kinase interacting serine/threonine kinase 2
  ENST ID: ENST00000591142
  CDS Start-End: 125-601
ggggcggggtccgagccggctggcgcaggtgacccgcagttacccgggctcggttcccacgtaatgctgggaaaccccggctgacgcgcccctcccccgcccgcagtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgctgtgtg

SEQ ID NO: 151634 - DNA, 454 bp, Homo sapiens
  Payload ID: 9847
  Gene Symbol: MKNK2
  Gene Name: MAP kinase interacting serine/threonine kinase 2
  ENST ID: ENST00000589534
  CDS Start-End: 234-454
gcggcggtggcccaggtagaggggtccgcgctggcggcggcggcggcgctgttccccgcgcggtccgcggagcggggtccgggctgcgcgacgtggggcggcggcggcactgcggccccggcccaagcccgaccccgggtcccctcctcggccgccccccgcccggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctggtgaggggcccgagggggaggagggcacagggcagctgctgtcgctgccatggcagtggccagcccctgcaggggggtgggg

SEQ ID NO: 151635 - DNA, 352 bp, Homo sapiens
  Payload ID: 9847
  Gene Symbol: MKNK2
  Gene Name: MAP kinase interacting serine/threonine kinase 2
  ENST ID: ENST00000589509
  CDS Start-End: 124-352
cggctcctctcagcggcggtggcccagggtcccctcctcggccgccccccgcccggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctggtgaggggcccgagggggaggagggcacagggcagctgctgtcgctgccatggcagtggccagcccctgcaggggggtggggacatgccc

SEQ ID NO: 151636 - DNA, 803 bp, Homo sapiens
  Payload ID: 9847
  Gene Symbol: MKNK2
  Gene Name: MAP kinase interacting serine/threonine kinase 2
  ENST ID: ENST00000589441
  CDS Start-End: 1-130
cagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgctgtgtg

SEQ ID NO: 151637 - DNA, 3582 bp, Homo sapiens
  Payload ID: 9847
  Gene Symbol: MKNK2
  Gene Name: MAP kinase interacting serine/threonine kinase 2
  Uniprot ID: Q9HBH9
  ENST ID: ENST00000591601
  CDS Start-End: 37-1434
cggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggttttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttttttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgctgtgtg

SEQ ID NO: 151638 - DNA, 2946 bp, Homo sapiens
  Payload ID: 9848
  Gene Symbol: MARK1
  Gene Name: MAP/microtubule affinity-regulating kinase 1
  Uniprot ID: Q9P0L2
  ENST ID: ENST00000366917
  CDS Start-End: 267-2654
cgggcaaccgcctcgcccgaagccctccctcgttactgtccgcataccccggcggcgccgccgcgggaagcggctccccctcctcttcctccgcgtcctcttccctctttcccccgccggggccgcttgttgcaccgccccgcggcctgcgggagccgctcgccccggccttgtgctcgcgtccgcacccctttcctgtcgccccccggggcccgcaccacagcccggccggcgagaccccggccagaccccgctgcccgcacaaaatgtcggcccggacgccattgccgacggtgaacgagcgggacacggaaaatcatacatctgtggatggatatactgaaccacacatccagcctaccaagtcgagtagcagacagaacatcccccggtgtagaaactccattacgtcagcaacagatgaacagcctcacattggaaattaccgtttacaaaaaacaatagggaagggaaattttgccaaagtcaaattggcaagacacgttctaactggtagagaggttgctgtgaaaataatagacaaaactcagctaaatcctaccagtctacaaaagttatttcgagaagtacgaataatgaagatactgaatcatcctaatatagtaaaattgtttgaagttattgaaacagagaagactctctatttagtcatggaatacgcgagtgggggtgaagtatttgattacttagttgcccatggaagaatgaaagagaaagaggcccgtgcaaaatttaggcagattgtatctgctgtacagtattgtcatcaaaagtacattgttcaccgtgatcttaaggctgaaaaccttctccttgatggtgatatgaatattaaaattgctgactttggttttagtaatgaatttacagttgggaacaaattggacacattttgtggaagcccaccctatgctgctcccgagcttttccaaggaaagaagtatgatgggcctgaagtggatgtgtggagtctgggcgtcattctctatacattagtcagtggctccttgcctttcgatggccagaatttaaaggaactgcgagagcgagttttacgagggaagtaccgtattcccttctatatgtccacagactgtgaaaatcttctgaagaaattattagtcctgaatccaataaagagaggcagcttggaacaaataatgaaagatcgatggatgaatgttggtcatgaagaggaagaactaaagccatatactgagcctgatccggatttcaatgacacaaaaagaatagacattatggtcaccatgggctttgcacgagatgaaataaatgatgccttaataaatcagaagtatgatgaagttatggctacttatattcttctaggtagaaaaccacctgaatttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatgctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtaacaatgtgtattctggaggtagcatggcaagaaggaatacatatgtctgtgaaaggaccacagatcgatacgtagcattgcagaatggaaaagacagcagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctggtacaacccagagagtgcctgctgcttccccatctgctcacagtattagtactgcgactccagaccggacccgttttccccgagggagctcaagccgaagcactttccatggtgaacagctccgggagcgacgcagcgttgcttataatgggccacctgcttcaccatcccatgaaacgggtgcatttgcacatgccagaaggggaacgtcaactggtataataagcaaaatcacatccaaatttgttcgcagggatccaagtgaaggcgaagccagtggcagaaccgacacctcaagaagtacatcaggggaaccaaaagaaagagacaaggaagagggtaaagattctaagccgcgttctttgcggttcacatggagtatgaagaccactagttcaatggaccctaatgacatgatgagagaaatccgaaaagtgttagatgcaaataactgtgattatgagcaaaaagagagatttttgcttttctgtgtccatggagacgctagacaggatagcctcgtgcagtgggagatggaagtctgcaagttgccacgactgtcacttaatggggttcgcttcaagcgaatatctgggacatctattgcctttaagaacattgcatcaaaaatagcaaatgagcttaagctgtaaagaagtccaaatttacaggttcagggaagatacatacatatatgaggtacagtttttgaatgtactggtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaaaaacttg

SEQ ID NO: 151639 - DNA, 5169 bp, Homo sapiens
  Payload ID: 9848
  Gene Symbol: MARK1
  Gene Name: MAP/microtubule affinity-regulating kinase 1
  Uniprot ID: Q9P0L2
  ENST ID: ENST00000366918
  CDS Start-End: 598-2874
ggcgcggcggcggcggtggctgtgaccgcgcggaccgagccgagacattcgcgccgggggatcgggcgccgccgccgctgggccccgggcgcgtggatgcggctgggtcgggcggcgccgtacacctgaggcggagaacggggcgcggcgcgggtgacgctgtcagggccgcggttcctgacgcccaggcgctcgccaggacgagccaggcagtgatttgaggcaccggcttcaccttcacccatggtccggagagcctagcggggctcgccaccgcctcccggctccccttccacgcctcatcctgccagcctcgccgccccgccagcgccgggcaaccgcctcgcccgaagccctccctcgttactgtccgcataccccggcggcgccgccgcgggaagcggctccccctcctcttcctccgcgtcctcttccctctttcccccgccggggccgcttgttgcaccgccccgcggcctgcgggagccgctcgccccggccttgtgctcgcgtccgcacccctttcctgtcgccccccggggcccgcaccacagcccggccggcgagaccccggccagaccccgctgcccgcacaaaatgtcggcccggacgccattgccgacggtgaacgagcgggacacggaaaatcatacatctgtggatggatatactgaaccacacatccagcctaccaagtcgagtagcagacagaacatcccccggtgtagaaactccattacgtcagcaacagatgaacagcctcacattggaaattaccgtttacaaaaaacaatagggaagggaaattttgccaaagtcaaattggcaagacacgttctaactggtagagaggttgctgtgaaaataatagacaaaactcagctaaatcctaccagtctacaaaagttatttcgagaagtacgaataatgaagatactgaatcatcctaatataggtgaagtatttgattacttagttgcccatggaagaatgaaagagaaagaggcccgtgcaaaatttaggcagattgtatctgctgtacagtattgtcatcaaaagtacattgttcaccgtgatcttaaggctgaaaaccttctccttgatggtgatatgaatattaaaattgctgactttggttttagtaatgaatttacagttgggaacaaattggacacattttgtggaagcccaccctatgctgctcccgagcttttccaaggaaagaagtatgatgggcctgaagtggatgtgtggagtctgggcgtcattctctatacattagtcagtggctccttgcctttcgatggccagaatttaaaggaactgcgagagcgagttttacgagggaagtaccgtattcccttctatatgtccacagactgtgaaaatcttctgaagaaattattagtcctgaatccaataaagagaggcagcttggaacaaataatgaaagatcgatggatgaatgttggtcatgaagaggaagaactaaagccatatactgagcctgatccggatttcaatgacacaaaaagaatagacattatggtcaccatgggctttgcacgagatgaaataaatgatgccttaataaatcagaagtatgatgaagttatggctacttatattcttctaggtagaaaaccacctgaatttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatgctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtaacaatgtgtattctggaggtagcatggcaagaaggaatacatatgtctgtgaaaggaccacagatcgatacgtagcattgcagaatggaaaagacagcagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctggtacaacccagagagtgcctgctgcttccccatctgctcacagtattagtactgcgactccagaccggacccgttttccccgagggagctcaagccgaagcactttccatggtgaacagctccgggagcgacgcagcgttgcttataatgggccacctgcttcaccatcccatgaaacgggtgcatttgcacatgccagaaggggaacgtcaactggtataataagcaaaatcacatccaaatttgttcgcagaagtacatcaggggaaccaaaagaaagagacaaggaagagggtaaagattctaagccgcgttctttgcggttcacatggagtatgaagaccactagttcaatggaccctaatgacatgatgagagaaatccgaaaagtgttagatgcaaataactgtgattatgagcaaaaagagagatttttgcttttctgtgtccatggagacgctagacaggatagcctcgtgcagtgggagatggaagtctgcaagttgccacgactgtcacttaatggggttcgcttcaagcgaatatctgggacatctattgcctttaagaacattgcatcaaaaatagcaaatgagcttaagctgtaaagaagtccaaatttacaggttcagggaagatacatacatatatgaggtacagtttttgaatgtactggtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaaaaacttgtatagttgtctagatttctgcacctgaatgtatgtttgatgctttgatttgaaaatgttcttccctgttatttacattctggtgggtttttaaaattcttacctccatcatgcaattttgaaaattgtgtccagaattaaaagtgcatagaaatagcctttacaattgtagcatggacctttaaaaattgttttaaaatcttatttaaatttaaaccagaagctgaaaaatagatcagctttattatacacaaaattattactgcttatctttgctcttttccttgttatcccgcaaggtttagttgagaagatacaaaatgtttacagtgttggcacttagagtttttaaattcaagtacatgaaattcagtaatagcattgccttgagctaactaggaagtaccgggaaaaaagttaaatctacatcaagtttcttttgaactttgaagtgttttctgacccactgctaactgtagcaacaaaatttaaaagaaaaaaaacatactttatctggctattataacataaactgtcacgtaggtttgctgccttcagaataccgcaatttaattgcgggaatataataatattgggactgtttcacagcacaaactcatctttacagtgttgatcaatgcatcagttaagaaataatgccacctcaggaattaactggcattgggaacatttgcctcattctcctgctatcctcttcattcacccctgccactgtaatatctataagtacttaagagacttgtgagcaaaacatactatttataacagtatatgattgatttatgcttatgtggttgttcagtttgttcccatgtaactcgtttgttttaaatattttgccagatttcttgtatttattccacatcattatgcctataatgtgccgctttgtgattgggcatttgcctacttttctttcataattagtgatatatgcgatgtaaaaccactagtaaaggtacattttaatacttgttattttatactgaattagccttggaggttgactgtgcaatgttatttactgttgtaattactgtaataccaacatatgggccccatctgcacactcctgaaaaacagaaagtgtattcaaattttatcagtttaaagaaaataaagctgtgataaatactgtaattccaacctacattagaaggtctaagtgtaggtgatgtgccattccataatggcttccagactagggtgaattttatgttctgtactgtactgtgatgtagctttcttctgtaacagttatgttttaaaattaagtgagttttttttttgccttagcaaagggtggtgtttgaaaaaaaaaatgtgtagcccctttttaacctagtgttcattcaaaaaaaaattgatgcaaatctttattcactttcactggtgcacactgaaattttacttgaacagttctcataataaagcacttgtcttttgctctttatcagaatgtgaattacctgttttctggtacaaaagtattctgtatgaggagtttattgtatgtgttctaaatttagttggcaaagggtgaagctgtgaaggttttcaagattattgaaactatgaaggtttcttgtcattatgacaagaaagtttaatctttttataggaattcctgtcactgaaatacgtttttaaaaaaatagactcatgtgttttccacggtagaaactgatatttttttacattttctcactgtggccaactcttctgtgtttgtagaaaggaatttgacttcaatatcttttatgaactaaaaatgaaatcttgatactcactttagatttttcattttatgtgttcatgacaacataaatatttttcaaagatttagaggaattttgcaatgtgtttgcataaataaataccagtttatgttcaccggctatgtgataccaggatttccttggcttctgttgaaatattatttgatatgacatcccttatattaaattaattattttgtagaaa

SEQ ID NO: 151640 - DNA, 5273 bp, Homo sapiens
  Payload ID: 9848
  Gene Symbol: MARK1
  Gene Name: MAP/microtubule affinity-regulating kinase 1
  ENST ID: ENST00000402574
  CDS Start-End: 641-2983
gctgctccgcgcgcagccggctcgggccgctcctcctgactgaggcgcggcggcggcggtggctgtgaccgcgcggaccgagccgagacattcgcgccgggggatcgggcgccgccgccgctgggccccgggcgcgtggatgcggctgggtcgggcggcgccgtacacctgaggcggagaacggggcgcggcgcgggtgacgctgtcagggccgcggttcctgacgcccaggcgctcgccaggacgagccaggcagtgatttgaggcaccggcttcaccttcacccatggtccggagagcctagcggggctcgccaccgcctcccggctccccttccacgcctcatcctgccagcctcgccgccccgccagcgccgggcaaccgcctcgcccgaagccctccctcgttactgtccgcataccccggcggcgccgccgcgggaagcggctccccctcctcttcctccgcgtcctcttccctctttcccccgccggggccgcttgttgcaccgccccgcggcctgcgggagccgctcgccccggccttgtgctcgcgtccgcacccctttcctgtcgccccccggggcccgcaccacagcccggccggcgagaccccggccagaccccgctgcccgcacaaaatgtcggcccggacgccattgccgacggtgaacgagcgggacacggaaaatcatacatctgtggatggatatactgaaccacacatccagcctaccaagtcgagtagcagacagaacatcccccggtgtagaaactccattacgtcagcaacagatgaacagcctcacattggaaattaccgtttacaaaaaacaatagggaagggaaattttgccaaagtcaaattggcaagacacgttctaactggtagagaggttgctgtgaaaataatagacaaaactcagctaaatcctaccagtctacaaaagttatttcgagaagtacgaataatgaagatactgaatcatcctaatatagtaaaattgtttgaagttattgaaacagagaagactctctatttagtcatggaatacgcgagtgggggtgaagtatttgattacttagttgcccatggaagaatgaaagagaaagaggcccgtgcaaaatttaggcagattgtatctgctgtacagtattgtcatcaaaagtacattgttcaccgtgatcttaaggctgaaaaccttctccttgatggtgatatgaatattaaaattgctgactttggttttagtaatgaatttacagttgggaacaaattggacacattttgtggaagcccaccctatgctgctcccgagcttttccaaggaaagaagtatgatgggcctgaagtggatgtgtggagtctgggcgtcattctctatacattagtcagtggctccttgcctttcgatggccagaatttaaaggaactgcgagagcgagttttacgagggaagtaccgtattcccttctatatgtccacagactgtgaaaatcttctgaagaaattattagtcctgaatccaataaagagaggcagcttggaacaaataatgaaagatcgatggatgaatgttggtcatgaagaggaagaactaaagccatatactgagcctgatccggatttcaatgacacaaaaagaatagacattatggtcaccatgggctttgcacgagatgaaataaatgatgccttaataaatcagaagtatgatgaagttatggctacttatattcttctaggtagaaaaccacctgaatttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatgctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtaacaatgtgtattctggaggtagcatggcaagaaggaatacatatgtctgtgaaaggaccacagatcgatacgtagcattgcagaatggaaaagacagcagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctggtacaacccagagagtgcctgctgcttccccatctgctcacagtattagtactgcgactccagaccggacccgttttccccgagggagctcaagccgaagcactttccatggtgaacagctccgggagcgacgcagcgttgcttataatgggccacctgcttcaccatcccatgaaacgggtgcatttgcacatgccagaaggggaacgtcaactggtataataagcaaaatcacatccaaatttgttcgcagaagtacatcaggggaaccaaaagaaagagacaaggaagagggtaaagattctaagccgcgttctttgcggttcacatggagtatgaagaccactagttcaatggaccctaatgacatgatgagagaaatccgaaaagtgttagatgcaaataactgtgattatgagcaaaaagagagatttttgcttttctgtgtccatggagacgctagacaggatagcctcgtgcagtgggagatggaagtctgcaagttgccacgactgtcacttaatggggttcgcttcaagcgaatatctgggacatctattgcctttaagaacattgcatcaaaaatagcaaatgagcttaagctgtaaagaagtccaaatttacaggttcagggaagatacatacatatatgaggtacagtttttgaatgtactggtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaaaaacttgtatagttgtctagatttctgcacctgaatgtatgtttgatgctttgatttgaaaatgttcttccctgttatttacattctggtgggtttttaaaattcttacctccatcatgcaattttgaaaattgtgtccagaattaaaagtgcatagaaatagcctttacaattgtagcatggacctttaaaaattgttttaaaatcttatttaaatttaaaccagaagctgaaaaatagatcagctttattatacacaaaattattactgcttatctttgctcttttccttgttatcccgcaaggtttagttgagaagatacaaaatgtttacagtgttggcacttagagtttttaaattcaagtacatgaaattcagtaatagcattgccttgagctaactaggaagtaccgggaaaaaagttaaatctacatcaagtttcttttgaactttgaagtgttttctgacccactgctaactgtagcaacaaaatttaaaagaaaaaaaacatactttatctggctattataacataaactgtcacgtaggtttgctgccttcagaataccgcaatttaattgcgggaatataataatattgggactgtttcacagcacaaactcatctttacagtgttgatcaatgcatcagttaagaaataatgccacctcaggaattaactggcattgggaacatttgcctcattctcctgctatcctcttcattcacccctgccactgtaatatctataagtacttaagagacttgtgagcaaaacatactatttataacagtatatgattgatttatgcttatgtggttgttcagtttgttcccatgtaactcgtttgttttaaatattttgccagatttcttgtatttattccacatcattatgcctataatgtgccgctttgtgattgggcatttgcctacttttctttcataattagtgatatatgcgatgtaaaaccactagtaaaggtacattttaatacttgttattttatactgaattagccttggaggttgactgtgcaatgttatttactgttgtaattactgtaataccaacatatgggccccatctgcacactcctgaaaaacagaaagtgtattcaaattttatcagtttaaagaaaataaagctgtgataaatactgtaattccaacctacattagaaggtctaagtgtaggtgatgtgccattccataatggcttccagactagggtgaattttatgttctgtactgtactgtgatgtagctttcttctgtaacagttatgttttaaaattaagtgagttttttttttgccttagcaaagggtggtgtttgaaaaaaaaaatgtgtagcccctttttaacctagtgttcattcaaaaaaaaattgatgcaaatctttattcactttcactggtgcacactgaaattttacttgaacagttctcataataaagcacttgtcttttgctctttatcagaatgtgaattacctgttttctggtacaaaagtattctgtatgaggagtttattgtatgtgttctaaatttagttggcaaagggtgaagctgtgaaggttttcaagattattgaaactatgaaggtttcttgtcattatgacaagaaagtttaatctttttataggaattcctgtcactgaaatacgtttttaaaaaaatagactcatgtgttttccacggtagaaactgatatttttttacattttctcactgtggccaactcttctgtgtttgtagaaaggaatttgacttcaatatcttttatgaactaaaaatgaaatcttgatactcactttagatttttcattttatgtgttcatgacaacataaatatttttcaaagatttagaggaattttgcaatgtgtttgcataaataaataccagtttatgttcaccggctatgtgataccaggatttccttggcttctgttgaaatattatttgatatgacatcccttatattaaattaattattttgt

SEQ ID NO: 151641 - DNA, 5321 bp, Homo sapiens
  Payload ID: 9848
  Gene Symbol: MARK1
  Gene Name: MAP/microtubule affinity-regulating kinase 1
  ENST ID: ENST00000611084
  CDS Start-End: 641-3031
gctgctccgcgcgcagccggctcgggccgctcctcctgactgaggcgcggcggcggcggtggctgtgaccgcgcggaccgagccgagacattcgcgccgggggatcgggcgccgccgccgctgggccccgggcgcgtggatgcggctgggtcgggcggcgccgtacacctgaggcggagaacggggcgcggcgcgggtgacgctgtcagggccgcggttcctgacgcccaggcgctcgccaggacgagccaggcagtgatttgaggcaccggcttcaccttcacccatggtccggagagcctagcggggctcgccaccgcctcccggctccccttccacgcctcatcctgccagcctcgccgccccgccagcgccgggcaaccgcctcgcccgaagccctccctcgttactgtccgcataccccggcggcgccgccgcgggaagcggctccccctcctcttcctccgcgtcctcttccctctttcccccgccggggccgcttgttgcaccgccccgcggcctgcgggagccgctcgccccggccttgtgctcgcgtccgcacccctttcctgtcgccccccggggcccgcaccacagcccggccggcgagaccccggccagaccccgctgcccgcacaaaatgtcggcccggacgccattgccgacggtgaacgagcgggacacggaaaatcatacatctgtggatggatatactgaaccacacatccagcctaccaagtcgagtagcagacagaacatcccccggtgtagaaactccattacgtcagcaacagatgaacagcctcacattggaaattaccgtttacaaaaaacaatagggaagggaaattttgccaaagtcaaattggcaagacacgttctaactggtagagaggttgctgtgaaaataatagacaaaactcagctaaatcctaccagtctacaaaagttatttcgagaagtacgaataatgaagatactgaatcatcctaatatagtaaaattgtttgaagttattgaaacagagaagactctctatttagtcatggaatacgcgagtgggggtgaagtatttgattacttagttgcccatggaagaatgaaagagaaagaggcccgtgcaaaatttaggcagattgtatctgctgtacagtattgtcatcaaaagtacattgttcaccgtgatcttaaggctgaaaaccttctccttgatggtgatatgaatattaaaattgctgactttggttttagtaatgaatttacagttgggaacaaattggacacattttgtggaagcccaccctatgctgctcccgagcttttccaaggaaagaagtatgatgggcctgaagtggatgtgtggagtctgggcgtcattctctatacattagtcagtggctccttgcctttcgatggccagaatttaaaggaactgcgagagcgagttttacgagggaagtaccgtattcccttctatatgtccacagactgtgaaaatcttctgaagaaattattagtcctgaatccaataaagagaggcagcttggaacaaataatgaaagatcgatggatgaatgttggtcatgaagaggaagaactaaagccatatactgagcctgatccggatttcaatgacacaaaaagaatagacattatggtcaccatgggctttgcacgagatgaaataaatgatgccttaataaatcagaagtatgatgaagttatggctacttatattcttctaggtagaaaaccacctgaatttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatgctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtaacaatgtgtattctggaggtagcatggcaagaaggaatacatatgtctgtgaaaggaccacagatcgatacgtagcattgcagaatggaaaagacagcagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctggcagtacaacccagagagtgcctgctgcttccccatctgctcacagtattagtactgcgactccagaccggacccgttttccccgagggagctcaagccgaagcactttccatggtgaacagctccgggagcgacgcagcgttgcttataatgggccacctgcttcaccatcccatgaaacgggtgcatttgcacatgccagaaggggaacgtcaactggtataataagcaaaatcacatccaaatttgttcgcagggatccaagtgaaggcgaagccagtggcagaaccgacacctcaagaagtacatcaggggaaccaaaagaaagagacaaggaagagggtaaagattctaagccgcgttctttgcggttcacatggagtatgaagaccactagttcaatggaccctaatgacatgatgagagaaatccgaaaagtgttagatgcaaataactgtgattatgagcaaaaagagagatttttgcttttctgtgtccatggagacgctagacaggatagcctcgtgcagtgggagatggaagtctgcaagttgccacgactgtcacttaatggggttcgcttcaagcgaatatctgggacatctattgcctttaagaacattgcatcaaaaatagcaaatgagcttaagctgtaaagaagtccaaatttacaggttcagggaagatacatacatatatgaggtacagtttttgaatgtactggtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaaaaacttgtatagttgtctagatttctgcacctgaatgtatgtttgatgctttgatttgaaaatgttcttccctgttatttacattctggtgggtttttaaaattcttacctccatcatgcaattttgaaaattgtgtccagaattaaaagtgcatagaaatagcctttacaattgtagcatggacctttaaaaattgttttaaaatcttatttaaatttaaaccagaagctgaaaaatagatcagctttattatacacaaaattattactgcttatctttgctcttttccttgttatcccgcaaggtttagttgagaagatacaaaatgtttacagtgttggcacttagagtttttaaattcaagtacatgaaattcagtaatagcattgccttgagctaactaggaagtaccgggaaaaaagttaaatctacatcaagtttcttttgaactttgaagtgttttctgacccactgctaactgtagcaacaaaatttaaaagaaaaaaaacatactttatctggctattataacataaactgtcacgtaggtttgctgccttcagaataccgcaatttaattgcgggaatataataatattgggactgtttcacagcacaaactcatctttacagtgttgatcaatgcatcagttaagaaataatgccacctcaggaattaactggcattgggaacatttgcctcattctcctgctatcctcttcattcacccctgccactgtaatatctataagtacttaagagacttgtgagcaaaacatactatttataacagtatatgattgatttatgcttatgtggttgttcagtttgttcccatgtaactcgtttgttttaaatattttgccagatttcttgtatttattccacatcattatgcctataatgtgccgctttgtgattgggcatttgcctacttttctttcataattagtgatatatgcgatgtaaaaccactagtaaaggtacattttaatacttgttattttatactgaattagccttggaggttgactgtgcaatgttatttactgttgtaattactgtaataccaacatatgggccccatctgcacactcctgaaaaacagaaagtgtattcaaattttatcagtttaaagaaaataaagctgtgataaatactgtaattccaacctacattagaaggtctaagtgtaggtgatgtgccattccataatggcttccagactagggtgaattttatgttctgtactgtactgtgatgtagctttcttctgtaacagttatgttttaaaattaagtgagttttttttttgccttagcaaagggtggtgtttgaaaaaaaaaatgtgtagcccctttttaacctagtgttcattcaaaaaaaaattgatgcaaatctttattcactttcactggtgcacactgaaattttacttgaacagttctcataataaagcacttgtcttttgctctttatcagaatgtgaattacctgttttctggtacaaaagtattctgtatgaggagtttattgtatgtgttctaaatttagttggcaaagggtgaagctgtgaaggttttcaagattattgaaactatgaaggtttcttgtcattatgacaagaaagtttaatctttttataggaattcctgtcactgaaatacgtttttaaaaaaatagactcatgtgttttccacggtagaaactgatatttttttacattttctcactgtggccaactcttctgtgtttgtagaaaggaatttgacttcaatatcttttatgaactaaaaatgaaatcttgatactcactttagatttttcattttatgtgttcatgacaacataaatatttttcaaagatttagaggaattttgcaatgtgtttgcataaataaataccagtttatgttcaccggctatgtgataccaggatttccttggcttctgttgaaatattatttgatatgacatcccttatattaaattaattattttgt

SEQ ID NO: 151642 - DNA, 2903 bp, Homo sapiens
  Payload ID: 9849
  Gene Symbol: MARK2
  Gene Name: MAP/microtubule affinity-regulating kinase 2
  Uniprot ID: Q7KZI7
  ENST ID: ENST00000350490
  CDS Start-End: 415-2544
gaaaagagccgagggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaa

SEQ ID NO: 151643 - DNA, 3004 bp, Homo sapiens
  Payload ID: 9849
  Gene Symbol: MARK2
  Gene Name: MAP/microtubule affinity-regulating kinase 2
  Uniprot ID: Q7KZI7
  ENST ID: ENST00000361128
  CDS Start-End: 503-2662
gaattcacccgtagtctgtggccgggaggagaaggcgcgccccacctcccgtttctagccgcttcggatgtttccggctgctgccggcgaaaagagccgagggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggcagctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcagaaatctgtctttcaggtttgccagaagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaag

SEQ ID NO: 151644 - DNA, 4560 bp, Homo sapiens
  Payload ID: 9849
  Gene Symbol: MARK2
  Gene Name: MAP/microtubule affinity-regulating kinase 2
  ENST ID: ENST00000377810
  CDS Start-End: 679-2778
aaacagagccgaagcttcgtcttcggaatcgaggaggagagcgcgtccccggggtttaccttcttcggctgtttccggaattcacccgtagtctgtggccgggaggagaaggcgcgccccacctcccgtttctagccgcttcggatgtttccggctgctgccggcgaaaagagccgagggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttattttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctg

SEQ ID NO: 151645 - DNA, 4728 bp, Homo sapiens
  Payload ID: 9849
  Gene Symbol: MARK2
  Gene Name: MAP/microtubule affinity-regulating kinase 2
  Uniprot ID: Q7KZI7
  ENST ID: ENST00000402010
  CDS Start-End: 580-2946
aaacagagccgaagcttcgtcttcggaatcgaggaggagagcgcgtccccggggtttaccttcttcggctgtttccggaattcacccgtagtctgtggccgggaggagaaggcgcgccccacctcccgtttctagccgcttcggatgtttccggctgctgccggcgaaaagagccgagggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggcagctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcagaaatctgtctttcaggtttgccagaaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttattttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctg

SEQ ID NO: 151646 - DNA, 2112 bp, Homo sapiens
  Payload ID: 9849
  Gene Symbol: MARK2
  Gene Name: MAP/microtubule affinity-regulating kinase 2
  Uniprot ID: Q7KZI7
  ENST ID: ENST00000408948
  CDS Start-End: 19-2094
cccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcggg

SEQ ID NO: 151647 - DNA, 2100 bp, Homo sapiens
  Payload ID: 9849
  Gene Symbol: MARK2
  Gene Name: MAP/microtubule affinity-regulating kinase 2
  ENST ID: ENST00000425897
  CDS Start-End: 1-2100
atgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaa

SEQ ID NO: 151648 - DNA, 2671 bp, Homo sapiens
  Payload ID: 9849
  Gene Symbol: MARK2
  Gene Name: MAP/microtubule affinity-regulating kinase 2
  Uniprot ID: Q7KZI7
  ENST ID: ENST00000513765
  CDS Start-End: 50-2317
gcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggcagctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcagaaatctgtctttcaggtttgccagaaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaa

SEQ ID NO: 151649 - DNA, 2885 bp, Homo sapiens
  Payload ID: 9849
  Gene Symbol: MARK2
  Gene Name: MAP/microtubule affinity-regulating kinase 2
  ENST ID: ENST00000502399
  CDS Start-End: 213-2549
gcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattacc

SEQ ID NO: 151650 - DNA, 411 bp, Homo sapiens
  Payload ID: 9849
  Gene Symbol: MARK2
  Gene Name: MAP/microtubule affinity-regulating kinase 2
  ENST ID: ENST00000512060
  CDS Start-End: 230-411
ctctctgctagtggtggtttcggttgcgacaccgtccaggttcccaggcaggaaccgctcggcctggctgcttagctacttttcactgaggaggtggtggaaggtgtcgcctgctctggctgagtaagggtggctggctgagccggcagcccccgccctaggcctggctcttcccggcctctgtactttgccctcgctgcctgacaggttctgctgtgggctctgctgaatggaagtcgctggtagtccttttccctttctccagtcggtggcttgcctccttaccctggctcacatccctgctgtgggaaacatcttacagcatagaagaaggggtgcagggcccaccttgggacaccttgactccaagcccagcagtaagtccaacatgattcggggccgcaactcagc

SEQ ID NO: 151651 - DNA, 2862 bp, Homo sapiens
  Payload ID: 9849
  Gene Symbol: MARK2
  Gene Name: MAP/microtubule affinity-regulating kinase 2
  Uniprot ID: Q7KZI7
  ENST ID: ENST00000509502
  CDS Start-End: 464-2701
cttcctgccctattcccctcctgccccttccctcccaccttgcttctggtgtgctgtcctggaattgcacgcgcttcctgaccaccaggctctggcccttgagaagccagcggggctttgtccctgttgctctccttgccaaacccagtctctctgctagtggtggtttcggttgcgacaccgtccaggttcccaggcaggaaccgctcggcctggctgcttagctacttttcactgaggaggtggtggaaggtgtcgcctgctctggctgagtaagggtggctggctgagccggcagcccccgccctaggcctggctcttcccggcctctgtactttgccctcgctgcctgacaggttctgctgtgggctctgctgaatggaagtcgctggtagtccttttccctttctccagtcggcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgt

SEQ ID NO: 151652 - DNA, 2924 bp, Homo sapiens
  Payload ID: 9849
  Gene Symbol: MARK2
  Gene Name: MAP/microtubule affinity-regulating kinase 2
  Uniprot ID: Q7KZI7
  ENST ID: ENST00000508192
  CDS Start-End: 503-2677
gaattcacccgtagtctgtggccgggaggagaaggcgcgccccacctcccgtttctagccgcttcggatgtttccggctgctgccggcgaaaagagccgagggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaagg

SEQ ID NO: 151653 - DNA, 558 bp, Homo sapiens
  Payload ID: 9849
  Gene Symbol: MARK2
  Gene Name: MAP/microtubule affinity-regulating kinase 2
  ENST ID: ENST00000540169
  CDS Start-End: 224-558
agtttctcttcatggattacctgctcgcggcaggcaggcaggcagctccccacctggaagcctgcagactcgccgagctgagagaatcatgctgcagatctcatgcttcttttttactttgtgttggcaaaaaccccaggagaagatgggagattctgggaggagatgattatgctggcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatgg

SEQ ID NO: 151654 - DNA, 557 bp, Homo sapiens
  Payload ID: 9849
  Gene Symbol: MARK2
  Gene Name: MAP/microtubule affinity-regulating kinase 2
  ENST ID: ENST00000543674
  CDS Start-End: 285-557
agtatcttaagtaggtgtggtaatgactacagagaagtgctttttcaggatgagaagatgagggagaaaatttacaccattgctggattgtgttaagaactcggagaggaaaccacagggaggatgcactgctgaggaaatcgtctggcttcctggagtggggaccagagccagagagccaagccctcctggctttgctgagttctgtccttgcccctgacaccaacgtgtctgcctgcgttgttgctcctggttacagtgggctcagtcttgcctcttttttgatgggtgggcagaggaacactagtgttgggaatattgtccagcgttggagagatcatgtggtctgtcagaaggctggagttatttatagtgggagaaaagcccaggagcatggcacgggaagaactgatttcacaccagctcagcgcctgatgatgcccaccttgggacaccttgactccaagcccagcagtaagtccaacatgattcggggccgcaactcagccacctctgctgatgagcagccccacattggaaactaccggctcctcaag

SEQ ID NO: 151655 - DNA, 595 bp, Homo sapiens
  Payload ID: 9849
  Gene Symbol: MARK2
  Gene Name: MAP/microtubule affinity-regulating kinase 2
  ENST ID: ENST00000543220
  CDS Start-End: 113-595
gatcattgtcattattgttccagttgaacaacacagtgaattttatctgagcaccacacaactctagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagacttt

SEQ ID NO: 151656 - DNA, 2911 bp, Homo sapiens
  Payload ID: 9850
  Gene Symbol: MARK3
  Gene Name: MAP/microtubule affinity-regulating kinase 3
  ENST ID: ENST00000216288
  CDS Start-End: 171-2312
gacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggtgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcag

SEQ ID NO: 151657 - DNA, 3283 bp, Homo sapiens
  Payload ID: 9850
  Gene Symbol: MARK3
  Gene Name: MAP/microtubule affinity-regulating kinase 3
  Uniprot ID: P27448
  ENST ID: ENST00000303622
  CDS Start-End: 490-2679
gctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggtgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 151658 - DNA, 2331 bp, Homo sapiens
  Payload ID: 9850
  Gene Symbol: MARK3
  Gene Name: MAP/microtubule affinity-regulating kinase 3
  ENST ID: ENST00000335102
  CDS Start-End: 1-2331
atgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagggttgtcaagctggacagactattaaagttcaagtctcctttgatttgcttagtctgatgtttacatttattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagaaacatgtcattcaggtttatcaaaaggcttccaactgaatatgagaggaacgggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaa

SEQ ID NO: 151659 - DNA, 2643 bp, Homo sapiens
  Payload ID: 9850
  Gene Symbol: MARK3
  Gene Name: MAP/microtubule affinity-regulating kinase 3
  ENST ID: ENST00000440884
  CDS Start-End: 639-2618
ggaagccgaggggcggccatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagaaacatgtcattcaggtttatcaaaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaag

SEQ ID NO: 151660 - DNA, 2969 bp, Homo sapiens
  Payload ID: 9850
  Gene Symbol: MARK3
  Gene Name: MAP/microtubule affinity-regulating kinase 3
  ENST ID: ENST00000416682
  CDS Start-End: 578-2836
gcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagggttgtcaagctggacagactattaaagttcaagtctcctttgatttgcttagtctgatgtttacatttattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagc

SEQ ID NO: 151661 - DNA, 3371 bp, Homo sapiens
  Payload ID: 9850
  Gene Symbol: MARK3
  Gene Name: MAP/microtubule affinity-regulating kinase 3
  ENST ID: ENST00000429436
  CDS Start-End: 511-2772
caggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagaaacatgtcattcaggtttatcaaaaggcttccaactgaatatgagaggaacgggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggtgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcag

SEQ ID NO: 151662 - DNA, 1571 bp, Homo sapiens
  Payload ID: 9850
  Gene Symbol: MARK3
  Gene Name: MAP/microtubule affinity-regulating kinase 3
  ENST ID: ENST00000554627
  CDS Start-End: 1-1517
aagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagaaacatgtcattcaggtttatcaaaaggcttccaactgaatatgagaggaacgggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactg

SEQ ID NO: 151663 - DNA, 2298 bp, Homo sapiens
  Payload ID: 9850
  Gene Symbol: MARK3
  Gene Name: MAP/microtubule affinity-regulating kinase 3
  Uniprot ID: P27448
  ENST ID: ENST00000553942
  CDS Start-End: 46-2280
gttttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggaggcttccaactgaatatgagaggaacgggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgta

SEQ ID NO: 151664 - DNA, 1051 bp, Homo sapiens
  Payload ID: 9850
  Gene Symbol: MARK3
  Gene Name: MAP/microtubule affinity-regulating kinase 3
  ENST ID: ENST00000556744
  CDS Start-End: 1-996
gctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcctgacagaaatgttcgcttacgcagctagccctgcctcagtttgtacatctacctgtcggctgagacatcagaagtcgatgtccatgtcagcctctgggcaccccaagatgatgttacctccaatagacagtgaaggagataacttcaaggctatcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggaggcttccaactgaatatgagaggaacgggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactga

SEQ ID NO: 151665 - DNA, 523 bp, Homo sapiens
  Payload ID: 9850
  Gene Symbol: MARK3
  Gene Name: MAP/microtubule affinity-regulating kinase 3
  ENST ID: ENST00000561225
  CDS Start-End: 136-523
agaagtctgccgtgtcccgctgttcgcgggcgggtctgcgaagtacatcgattatgccggcagtctagtcggttaataaagcccaggagttgcagcgttacggatcggtgctttgagaggccaggttgccgcgcaatggattgtgcaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtaagaacattt

SEQ ID NO: 151666 - DNA, 724 bp, Homo sapiens
  Payload ID: 9850
  Gene Symbol: MARK3
  Gene Name: MAP/microtubule affinity-regulating kinase 3
  ENST ID: ENST00000561314
  CDS Start-End: 1-669
gctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactga

SEQ ID NO: 151667 - DNA, 579 bp, Homo sapiens
  Payload ID: 9850
  Gene Symbol: MARK3
  Gene Name: MAP/microtubule affinity-regulating kinase 3
  ENST ID: ENST00000560417
  CDS Start-End: 44-579
tttgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagattt

SEQ ID NO: 151668 - DNA, 3573 bp, Homo sapiens
  Payload ID: 9851
  Gene Symbol: MARK4
  Gene Name: MAP/microtubule affinity-regulating kinase 4
  Uniprot ID: Q96L34
  ENST ID: ENST00000262891
  CDS Start-End: 332-2590
ctgacgtcccttcctccctccccagcccctccaccgcctccctccgccgccgcttgggccggctccgcgccccctccgcggcccccgcccgcccgcctgcccgccgcccccatggcgcccggggtccccgctgcacggggccactaggaccctcggcgtcccttcccctcccccgccctgccccctctcccgccgcgcggacccgggcgttctcggcgcccagcttttgagctcgcgtccccaggccggcggggggggaggggaagagaggggaccctgggacccccgccccccccacccggccgcccctgccccccgggacccggagaagatgtcttcgcggacggtgctggccccgggcaacgatcggaactcggacacgcatggcaccttgggcagtggccgctcctcggacaaaggcccgtcctggtccagccgctcactgggtgcccgttgccggaactccatcgcctcctgtcccgaggagcagccccacgtgggcaactaccgcctgctgaggaccattgggaagggcaactttgccaaagtcaagctggctcggcacatcctcactggtcgggaggttgccatcaagattatcgacaaaacccagctgaatcccagcagcctgcagaagctgttccgagaagtccgcatcatgaagggcctaaaccaccccaacatcgtgaagctctttgaggtgattgagactgagaagacgctgtacctggtgatggagtacgcaagtgctggagaagtgtttgactacctcgtgtcgcatggccgcatgaaggagaaggaagctcgagccaagttccgacagattgtttcggctgtgcactattgtcaccagaaaaatattgtacacagggacctgaaggctgagaacctcttgctggatgccgaggccaacatcaagattgctgactttggcttcagcaacgagttcacgctgggatcgaagctggacacgttctgcgggagccccccatatgccgccccggagctgtttcagggcaagaagtacgacgggccggaggtggacatctggagcctgggagtcatcctgtacaccctcgtcagcggctccctgcccttcgacgggcacaacctcaaggagctgcgggagcgagtactcagagggaagtaccgggtccctttctacatgtcaacagactgtgagagcatcctgcggagatttttggtgctgaacccagctaaacgctgtactctcgagcaaatcatgaaagacaaatggatcaacatcggctatgagggtgaggagttgaagccatacacagagcccgaggaggacttcggggacaccaagagaattgaggtgatggtgggtatgggctacacacgggaagaaatcaaagagtccttgaccagccagaagtacaacgaagtgaccgccacctacctcctgctgggcaggaagactgaggagggtggggaccggggcgccccagggctggccctggcacgggtgcgggcgcccagcgacaccaccaacggaacaagttccagcaaaggcaccagccacagcaaagggcagcggagttcctcttccacctaccaccgccagcgcaggcatagcgatttctgtggcccatcccctgcacccctgcaccccaaacgcagcccgacgagcacgggggaggcggagctgaaggaggagcggctgccaggccggaaggcgagctgcagcaccgcggggagtgggagtcgagggctgcccccctccagccccatggtcagcagcgcccacaaccccaacaaggcagagatcccagagcggcggaaggacagcacgagcacccccaacaacctccctcctagcatgatgacccgcagaaacacctacgtttgcacagaacgcccgggggctgagcgcccgtcactgttgccaaatgggaaagaaaacagctcaggcaccccacgggtgccccctgcctccccctccagtcacagcctggcacccccatcaggggagcggagccgcctggcacgtggttccaccatccgcagcaccttccatggtggccaggtccgggaccggcgggcagggggtgggggtggtgggggtgtgcagaatgggccccctgcctctcccacactggcccatgaggctgcacccctgcccgccgggcggccccgccccaccaccaacctcttcaccaagctgacctccaaactgacccgaagggtcgcagacgaacctgagagaatcgggggacctgaggtcacaagttgccatctaccttgggatcaaacggaaaccgccccccggctgctccgattcccctggagtgtgaagctgaccagctcgcgccctcctgaggccctgatggcagctctgcgccaggccacagcagccgcccgctgccgctgccgccagccacagccgttcctgctggcctgcctgcacgggggtgcgggcgggcccgagcccctgtcccacttcgaagtggaggtctgccagctgccccggccaggcttgcggggagttctcttccgccgtgtggcgggcaccgccctggccttccgcaccctcgtcacccgcatctccaacgacctcgagctctgagccaccacggtcccagggcccttactcttcctctcccttgtcgccttcacttctacaggaggggaaggggccagggaggggattctccctttatcatcacctcagtttccctgaattatatttgggggcaaagattgtcccctctgctgttctctggggccgctcagcacagaagaaggatgagggggctcagcggggggagctggcaccttcctggagcctccagccagtcctgtcctccctcgccctaccaagagggcacctgaggagactttggggacagggcaggggcagggagggaaactgaggaaatcttccattcctcccaacagctcaaaattaggccttgggcaggggcagggagagctgctgagcctaaagactggagaatctgggggactgggagtgggggtcagagaggcagattccttcccctcccgtcccctcacgctcaaacccccacttcctgccccaggctggcgcggggcactttgtacaaatccttgtaaataccccacaccctcccctctgcaaaggtctcttgaggagctgccgctgtcacctacggtttttaagttattacaccccgaccctcctcctgtcagccccctcacctgcagcctgttgcccaataaatttaagagagtccccccctccccaatgctgaccctaggattttccttccctgccctcacctgcaaatgagttaaagaagaggcgtgggaatccaggcagtggtttttcctttcggagcctcggttttctcatctgcagaatgggagcggtgggggtgggaaggtaaggatggtcgtggaagaaggcaggatggaactcggcctcatccccgaggccccagttcctatatcgggccccccattcatccactcacactcccagccaccatgttacactggactctaagccacttcttactccagtagtaaatttattcaataaacaatcattgacccatgcctactcca

SEQ ID NO: 151669 - DNA, 5209 bp, Homo sapiens
  Payload ID: 9851
  Gene Symbol: MARK4
  Gene Name: MAP/microtubule affinity-regulating kinase 4
  Uniprot ID: Q96L34
  ENST ID: ENST00000300843
  CDS Start-End: 298-2364
cgcctccctccgccgccgcttgggccggctccgcgccccctccgcggcccccgcccgcccgcctgcccgccgcccccatggcgcccggggtccccgctgcacggggccactaggaccctcggcgtcccttcccctcccccgccctgccccctctcccgccgcgcggacccgggcgttctcggcgcccagcttttgagctcgcgtccccaggccggcggggggggaggggaagagaggggaccctgggacccccgccccccccacccggccgcccctgccccccgggacccggagaagatgtcttcgcggacggtgctggccccgggcaacgatcggaactcggacacgcatggcaccttgggcagtggccgctcctcggacaaaggcccgtcctggtccagccgctcactgggtgcccgttgccggaactccatcgcctcctgtcccgaggagcagccccacgtgggcaactaccgcctgctgaggaccattgggaagggcaactttgccaaagtcaagctggctcggcacatcctcactggtcgggaggttgccatcaagattatcgacaaaacccagctgaatcccagcagcctgcagaagctgttccgagaagtccgcatcatgaagggcctaaaccaccccaacatcgtgaagctctttgaggtgattgagactgagaagacgctgtacctggtgatggagtacgcaagtgctggagaagtgtttgactacctcgtgtcgcatggccgcatgaaggagaaggaagctcgagccaagttccgacagattgtttcggctgtgcactattgtcaccagaaaaatattgtacacagggacctgaaggctgagaacctcttgctggatgccgaggccaacatcaagattgctgactttggcttcagcaacgagttcacgctgggatcgaagctggacacgttctgcgggagccccccatatgccgccccggagctgtttcagggcaagaagtacgacgggccggaggtggacatctggagcctgggagtcatcctgtacaccctcgtcagcggctccctgcccttcgacgggcacaacctcaaggagctgcgggagcgagtactcagagggaagtaccgggtccctttctacatgtcaacagactgtgagagcatcctgcggagatttttggtgctgaacccagctaaacgctgtactctcgagcaaatcatgaaagacaaatggatcaacatcggctatgagggtgaggagttgaagccatacacagagcccgaggaggacttcggggacaccaagagaattgaggtgatggtgggtatgggctacacacgggaagaaatcaaagagtccttgaccagccagaagtacaacgaagtgaccgccacctacctcctgctgggcaggaagactgaggagggtggggaccggggcgccccagggctggccctggcacgggtgcgggcgcccagcgacaccaccaacggaacaagttccagcaaaggcaccagccacagcaaagggcagcggagttcctcttccacctaccaccgccagcgcaggcatagcgatttctgtggcccatcccctgcacccctgcaccccaaacgcagcccgacgagcacgggggaggcggagctgaaggaggagcggctgccaggccggaaggcgagctgcagcaccgcggggagtgggagtcgagggctgcccccctccagccccatggtcagcagcgcccacaaccccaacaaggcagagatcccagagcggcggaaggacagcacgagcacccccaacaacctccctcctagcatgatgacccgcagaaacacctacgtttgcacagaacgcccgggggctgagcgcccgtcactgttgccaaatgggaaagaaaacagctcaggcaccccacgggtgccccctgcctccccctccagtcacagcctggcacccccatcaggggagcggagccgcctggcacgtggttccaccatccgcagcaccttccatggtggccaggtccgggaccggcgggcagggggtgggggtggtgggggtgtgcagaatgggccccctgcctctcccacactggcccatgaggctgcacccctgcccgccgggcggccccgccccaccaccaacctcttcaccaagctgacctccaaactgacccgaagggttaccctcgatccctctaaacggcagaactctaaccgctgtgtttcgggcgcctctctgccccagggatccaagatcaggtcgcagacgaacctgagagaatcgggggacctgaggtcacaagttgccatctaccttgggatcaaacggaaaccgccccccggctgctccgattcccctggagtgtgaagctgaccagctcgcgccctcctgaggccctgatggcagctctgcgccaggccacagcagccgcccgctgccgctgccgccagccacagccgttcctgctggcctgcctgcacgggggtgcgggcgggcccgagcccctgtcccacttcgaagtggaggtctgccagctgccccggccaggcttgcggggagttctcttccgccgtgtggcgggcaccgccctggccttccgcaccctcgtcacccgcatctccaacgacctcgagctctgagccaccacggtcccagggcccttactcttcctctcccttgtcgccttcacttctacaggaggggaaggggccagggaggggattctccctttatcatcacctcagtttccctgaattatatttgggggcaaagattgtcccctctgctgttctctggggccgctcagcacagaagaaggatgagggggctcagcggggggagctggcaccttcctggagcctccagccagtcctgtcctccctcgccctaccaagagggcacctgaggagactttggggacagggcaggggcagggagggaaactgaggaaatcttccattcctcccaacagctcaaaattaggccttgggcaggggcagggagagctgctgagcctaaagactggagaatctgggggactgggagtgggggtcagagaggcagattccttcccctcccgtcccctcacgctcaaacccccacttcctgccccaggctggcgcggggcactttgtacaaatccttgtaaataccccacaccctcccctctgcaaaggtctcttgaggagctgccgctgtcacctacggtttttaagttattacaccccgaccctcctcctgtcagccccctcacctgcagcctgttgcccaataaatttaagagagtccccccctccccaatgctgaccctaggattttccttccctgccctcacctgcaaatgagttaaagaagaggcgtgggaatccaggcagtggtttttcctttcggagcctcggttttctcatctgcagaatgggagcggtgggggtgggaaggtaaggatggtcgtggaagaaggcaggatggaactcggcctcatccccgaggccccagttcctatatcgggccccccattcatccactcacactcccagccaccatgttacactggactctaagccacttcttactccagtagtaaatttattcaataaacaatcattgacccatgcctactccatgccaggcccagtgctggacacagagacatgaagctctgtctgtgggagacagggattctgacacagacaccggacaaaccattgtcttggggagcccagaagagaaagtgggcagggtggggtcattggggaagatgctctagaggaattaatgctggaatggggtgttgaaggatgagtaggagttagttaggcattgagtttgccctgggcaaaagcccagaagtgggagtatgtggtatatcttcagagaactgggtaatttcagtgtggctgctgtgttgggcatggatggagaatcagcaagagaaatgctgtattaggactaataatccatctacgctgcttaagcaaaaaggtatttgttggtttatgttacttaatagtccaggggcacctggcttcaggtaggtttgatccaggcatcaggccattgcatctattttttcagtgtaagttgaattctagtaatttttatcaagtaagggctcctttcctggtggcacagatgacttcagcagttagaagtttctatccctccagctttctgcagcagaaagaccctcattgtcagtttcccagcaaaagtcccagggcagactctcattggcccaaatgggccatgtgattttctctaaaccaatcactgtgactctagagtggccagactcagagctgcacttagtaggggttcctcaaaggaaggtcaagtgtcatgagcaggagaaaaggcatgggagctggacagattatagtggttgaagtctgtgcagtacagaagggcggagcttattcacacagcacctttggggccaaaatgaataagctggactttctccccatggcactggggaaccatggaagttcagggaacttcagggaagaggcttggtcaattcctgagagcatcctctgtgctggggacacagtggtaatcaagacagccccaacactgccctcatagagctcacagtccaatggaggaggcagatgtgtcctcaggcagcgactgggcagggctggtataggggagtccagaggtgatgcctgcctcagccagggagggcttcctggaggagaaggagccagctagacatggataggagtgcgttttaggcacagcaaatggcacatacaagggccagggagcaagagagaggacaggtcctcaacaaatggcatgtgactttgtaagtgtagaattgctgtgaggtatggggctaggggcgtcagtagggccttgaaggttatggacaggggcctgggctttcttccaagggcactgggggagccatggcaaggttgtaggtagggtagagatgggcgggtttgtgctatgtgcagggtggaagggagggaagttgacaggtcagaagatcaggaaagaggtcggggctggacagatggggagagcgcagatagatttaagagagtcctgtgaggcaaagtgggcaggacctggtaacaggtgtctggactgtggctttggctggctcagaaggtccccactggcgtgtgtggtctatgtagcctctgggtgtggagctgggatcttcaactggggacagtacagtaaagaacatcacagc

SEQ ID NO: 151670 - DNA, 553 bp, Homo sapiens
  Payload ID: 9851
  Gene Symbol: MARK4
  Gene Name: MAP/microtubule affinity-regulating kinase 4
  ENST ID: ENST00000587566
  CDS Start-End: 367-553
aaggtggtggggggtcgccagcaggttccctctccccggccccagctctggacgctcaccccagtgcaacgccctgagtgacggaaagagcatggcaccttgggcagtggccgctcctcggacaaaggcccgtcctggtccagccgctcactgggtgcccgttgccggaactccatcgcctcctgtcccgaggagcagccccacgtgggcaactaccgcctgctgaggaccattgggaagggcaactttgccaaagtcaagctggctcggcacatcctcactggtcgggaggttgccatcaagattatcgacaaaacccagctgaatcccagcagcctgcagaagctgttccgagaagtccgcatcatgaagggcctaaaccaccccaacatcgtgaagctctttgaggtgattgagactgagaagacgctgtacctggtgatggagtacgcaagtgctggagaagtgtttgactacctcgtgtcgcatggccgcatgaaggagaaggaagctcgagccaagttccgacagattgtttcggctgtgcactatt

SEQ ID NO: 151671 - DNA, 594 bp, Homo sapiens
  Payload ID: 9851
  Gene Symbol: MARK4
  Gene Name: MAP/microtubule affinity-regulating kinase 4
  ENST ID: ENST00000590909
  CDS Start-End: 373-594
gaggggccggtagccaggcctcaagttaagtgcactagcccacgggttccacggaaggtgggattggatagctcatgctccatctcccccgcccagcatggcaccttgggcagtggccgctcctcggacaaaggcccgtcctggtccagccgctcactgggtgcccgttgccggaactccatcgcctcctgtcccgaggagcagccccacgtgggcaactaccgcctgctgaggaccattgggaagggcaactttgccaaagtcaagctggctcggcacatcctcactggtcgggaggttgccatcaagattatcgacaaaacccagctgaatcccagcagcctgcagaagctgttccgagaagtccgcatcatgaagggcctaaaccaccccaacatcgtgaagctctttgaggtgattgagactgagaagacgctgtacctggtgatggagtacgcaagtgctggagaagtgtttgactacctcgtgtcgcatggccgcatgaaggagaaggaagctcgagccaagttccgacagattgtttcggctgtgcactattgtcaccagaaaaatattgtacacagggacctgaag

SEQ ID NO: 151672 - DNA, 683 bp, Homo sapiens
  Payload ID: 9851
  Gene Symbol: MARK4
  Gene Name: MAP/microtubule affinity-regulating kinase 4
  ENST ID: ENST00000592762
  CDS Start-End: 203-496
gctgcacggggccactaggaccctcggcgtcccttcccctcccccgccctgccccctctcccgccgcgcggacccgggcgttctcggcgcccagcttttgagctcgcgtccccaggccggcggggggggaggggaagagaggggaccctgggacccccgccccccccacccggccgcccctgccccccgggacccggagaagatgtcttcgcggacggtgctggccccgggcaacgatcggaactcggacacggctgagaacctcttgctggatgccgaggccaacatcaagattgctgactttggcttcagcaacgagttcacgctgggatcgaagctggacacgttctgcgggagccccccatatgccgccccggagctgtttcagggcaagaagtacgacgggccggaggtggacatctggagcctgggagtcatcctgtacaccctcgtcagcggctccctgcccttcgacgggcacaacctcaagaggtgatggtgggtatgggctacacacgggaagaaatcaaagagtccttgaccagccagaagtacaacgaagtgaccgccacctacctcctgctgggcaggaagactgaggagggtggggaccggggcgccccagggctggccctggcacgggtgcgggcgcccagcgacaccaccaacggaacaagttccag

SEQ ID NO: 151673 - DNA, 789 bp, Homo sapiens
  Payload ID: 9851
  Gene Symbol: MARK4
  Gene Name: MAP/microtubule affinity-regulating kinase 4
  ENST ID: ENST00000592207
  CDS Start-End: 1-146
agaacctcttgctggatgccgaggccaacatcaagattgctgactttggcttcagcaacgagttcacgctgggatcgaagctggacacgttctgcgggagccccccatatgccgccccggagctgtttcagggcaagaaactgtgagagcatcctgcggagatttttggtgctgaacccagctaaacgctgtactctcgagcaaatcatgaaagacaaatggatcaacatcggctatgagggtgaggagttgaagccatacacagagcccgaggaggacttcggggacaccaagagaattgaggtgatggtgggtatgggctacacacgggaagaaatcaaagagtccttgaccagccagaagtacaacgaagtgaccgccacctacctcctgctgggcaggaagactgaggagggtggggaccggggcgccccagggctggccctggcacgggtgcgggcgcccagcgacaccaccaacggaacaagttccagcaaaggcaccagccacagcaaagggcagcggagttcctcttccacctaccaccgccagcgcaggcatagcgatttctgtggcccatcccctgcacccctgcaccccaaacgcagcccgacgagcacgggggaggcggagctgaaggaggagcggctgccaggccggaaggcgagctgcagcaccgcggggagtgggagtcgagggctgcccccctccagccccatggtcagcagcgcccacaaccccaacaaggcagagatcccagagcggcggaaggacagcacgagcaccccc

SEQ ID NO: 151674 - DNA, 2105 bp, Homo sapiens
  Payload ID: 9851
  Gene Symbol: MARK4
  Gene Name: MAP/microtubule affinity-regulating kinase 4
  ENST ID: ENST00000620044
  CDS Start-End: 203-496
gctgcacggggccactaggaccctcggcgtcccttcccctcccccgccctgccccctctcccgccgcgcggacccgggcgttctcggcgcccagcttttgagctcgcgtccccaggccggcggggggggaggggaagagaggggaccctgggacccccgccccccccacccggccgcccctgccccccgggacccggagaagatgtcttcgcggacggtgctggccccgggcaacgatcggaactcggacacggctgagaacctcttgctggatgccgaggccaacatcaagattgctgactttggcttcagcaacgagttcacgctgggatcgaagctggacacgttctgcgggagccccccatatgccgccccggagctgtttcagggcaagaagtacgacgggccggaggtggacatctggagcctgggagtcatcctgtacaccctcgtcagcggctccctgcccttcgacgggcacaacctcaagaggtgatggtgggtatgggctacacacgggaagaaatcaaagagtccttgaccagccagaagtacaacgaagtgaccgccacctacctcctgctgggcaggaagactgaggagggtggggaccggggcgccccagggctggccctggcacgggtgcgggcgcccagcgacaccaccaacggaacaagttccaccctgcccgccgggcggccccgccccaccaccaacctcttcaccaagctgacctccaaactgacccgaagggtcgcagacgaacctgagagaatcgggggacctgaggtcacaagttgccatctaccttgggatcaaacggaaaccgccccccggctgctccgattcccctggagtgtgaagctgaccagctcgcgccctcctgaggccctgatggcagctctgcgccaggccacagcagccgcccgctgccgctgccgccagccacagccgttcctgctggcctgcctgcacgggggtgcgggcgggcccgagcccctgtcccacttcgaagtggaggtctgccagctgccccggccaggcttgcggggagttctcttccgccgtgtggcgggcaccgccctggccttccgcaccctcgtcacccgcatctccaacgacctcgagctctgagccaccacggtcccagggcccttactcttcctctcccttgtcgccttcacttctacaggaggggaaggggccagggaggggattctccctttatcatcacctcagtttccctgaattatatttgggggcaaagattgtcccctctgctgttctctggggccgctcagcacagaagaaggatgagggggctcagcggggggagctggcaccttcctggagcctccagccagtcctgtcctccctcgccctaccaagagggcacctgaggagactttggggacagggcaggggcagggagggaaactgaggaaatcttccattcctcccaacagctcaaaattaggccttgggcaggggcagggagagctgctgagcctaaagactggagaatctgggggactgggagtgggggtcagagaggcagattccttcccctcccgtcccctcacgctcaaacccccacttcctgccccaggctggcgcggggcactttgtacaaatccttgtaaataccccacaccctcccctctgcaaaggtctcttgaggagctgccgctgtcacctacggtttttaagttattacaccccgaccctcctcctgtcagccccctcacctgcagcctgttgcccaataaatttaagagagtccccccctccccaatgctgaccctaggattttccttccctgccctcacctgcaaatgagttaaagaagaggcgtgggaatccaggcagtggtttttcctttcggagcctcggttttctcatctgcagaatgggagcggtgggggtgggaaggtaaggatggtcgtggaagaaggcaggatggaactcggcctcatccccgaggccccagttcctatatcgggccccccattcatccactcacactcccagccaccatgttacactggactctaagccacttcttactccagtagtaaatttattcaataaacaatcattgaccc

SEQ ID NO: 151675 - DNA, 1147 bp, Homo sapiens
  Payload ID: 9851
  Gene Symbol: MARK4
  Gene Name: MAP/microtubule affinity-regulating kinase 4
  ENST ID: ENST00000622871
  CDS Start-End: 249-488
ctccctcctagcatgatgacccgcagggttaccctcgatccctctaaacggcagaactctaaccgctgtgtttcgggcgcctctctgccccagggatccaagatcaggtcgcagacgaacctgagagaatcgggggacctgaggtcacaagttgccatctaccttgggatcaaacggaaaccgccccccggctgctccgattcccctggagtgtgaagctgaccagctcgcgccctcctgaggccctgatggcagctctgcgccaggccacagcagccgcccgctgccgctgccgccagccacagccgttcctgctggcctgcctgcacgggggtgcgggcgggcccgagcccctgtcccacttcgaagtggaggtctgccagctgccccggccaggcttgcggggagttctcttccgccgtgtggcgggcaccgccctggccttccgcaccctcgtcacccgcatctccaacgacctcgagctctgagccaccacggtcccagggcccttactcttcctctcccttgtcgccttcacttctacaggaggggaaggggccagggaggggattctccctttatcatcacctcagtttccctgaattatatttgggggcaaagattgtcccctctgctgttctctggggccgctcagcacagaagaaggatgagggggctcagcggggggagctggcaccttcctggagcctccagccagtcctgtcctccctcgccctaccaagagggcacctgaggagactttggggacagggcaggggcagggagggaaactgaggaaatcttccattcctcccaacagctcaaaattaggccttgggcaggggcagggagagctgctgagcctaaagactggagaatctgggggactgggagtgggggtcagagaggcagattccttcccctcccgtcccctcacgctcaaacccccacttcctgccccaggctggcgcggggcactttgtacaaatccttgtaaataccccacaccctcccctctgcaaaggtctcttgaggagctgccgctgtcacctacggtttttaagttattacaccccgaccctcctcctgtcagccccctcacctgcagcctgttgcccaataaatttaagagagtccccccctcccc

SEQ ID NO: 151676 - DNA, 1586 bp, Homo sapiens
  Payload ID: 9852
  Gene Symbol: MBIP
  Gene Name: MAP3K12 binding inhibitory protein 1
  Uniprot ID: Q9NS73
  ENST ID: ENST00000318473
  CDS Start-End: 40-1071
cttggtggtggtggtggtggggcggcctgagaagatatcatggctgctgccacggagcttaatcgcccgagcagcggtgacaggaacctggagcgaagatgcagacccaacctctcccgagaggtgctctacgaaatctttcgctccctacacaccctggttggacagcttgacctcagagatgatgtggtgaaaattacaatcgattggaacaagctccagagcctctcggcattccagcctgcattgctctttagtgcacttgaacaacacattttatatttacagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaaattgacagacgaatatctgcatttattgaaagaaagcaagctgaaatcaatgaaaacaacgtcagggaattttgcaatgttattgattgtaatcaagaaaatagttgtgcaagaactgatgcgatttttaccccttaccccggatttaaaagtcacgtaaaagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacagacaggtggtccagtgccaagagacatttatcagagaattaaaaaacttgaggataaaatccttgaattggaaggcatctctcctgaatattttcagtctgtaagcttttctggaaaaagaagaaaagttcaaccacctcaaaactattcactggctgaacttgatgagaaaattagtgccctcaaacaagccctcctcagaaaatcaagagaagcagaatccatggcaacccaccaccttccatgaaaaactcctctcatccttgtcattttacttttttgtatacatatgtgtaacttacactgttattaattcaacggatatatatttatcaatgtagacttctctgtgaagtcaaggtttattttcacatgagtccagcttgcagcaagtaatcttcaaatattccagtaagttttgaaataatgaatgcattgaaaatagcattgttggaatttattcccttctgttttaaaggaggtattttggaaattgaaaaacttaatttacaagtgctggtacatcttttttcttttgtggaccacaggaaggaagatttattttgatattgatactttaaaaggactttatatttgtaacattgatgttaaccagtttattagtttaaatcagtactttgcatataataagcattcaacaaaaatttattgactgaaatgaattttaaatgcatgtgtatgaacttgtttttcttaatctttaagatgtcagtattcatgtaaataaacaatagatccagc

SEQ ID NO: 151677 - DNA, 1449 bp, Homo sapiens
  Payload ID: 9852
  Gene Symbol: MBIP
  Gene Name: MAP3K12 binding inhibitory protein 1
  Uniprot ID: Q9NS73
  ENST ID: ENST00000359527
  CDS Start-End: 20-868
ggcggcctgagaagatatcatggctgctgccacggagcttaatcgcccgagcagcggtgacaggaacctggagcgaagatgcagacccaacctctcccgagaggtgctctacgaaatctttcgctccctacacaccctggttggacagcttgacctcagagatgatgtggtgaaaattacaatcgattggaacaagctccagagcctctcggcattccagcctgcattgctctttagtgcacttgaacaacacattttatatttacagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaaattgacagacgaatatctgcatttattgaaagaaagcaagctgaaatcaatgaaaacaacgtcagggaattttgcaatgttattgattgtaatcaagaaaatagttgtgcaagaactgatgcgatttttaccccttaccccggatttaaaagtcacgtaaaagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacagacagagcttttctggaaaaagaagaaaagttcaaccacctcaacagaactattcactggctgaacttgatgagaaaattagtgccctcaaacaagccctcctcagaaaatcaagagaagcagaatccatggcaacccaccaccttccatgaaaaactcctctcatccttgtcattttacttttttgtatacatatgtgtaacttacactgttattaattcaacggatatatatttatcaatgtagacttctctgtgaagtcaaggtttattttcacatgagtccagcttgcagcaagtaatcttcaaatattccagtaagttttgaaataatgaatgcattgaaaatagcattgttggaatttattcccttctgttttaaaggaggtattttggaaattgaaaaacttaatttacaagtgctggtacatcttttttcttttgtggaccacaggaaggaagatttattttgatattgatactttaaaaggactttatatttgtaacattgatgttaaccagtttattagtttaaatcagtactttgcatataataagcattcaacaaaaatttattgactgaaatgaattttaaatgcatgtgtatgaacttgtttttcttaatctttaagatgtcagtattcat

SEQ ID NO: 151678 - DNA, 1648 bp, Homo sapiens
  Payload ID: 9852
  Gene Symbol: MBIP
  Gene Name: MAP3K12 binding inhibitory protein 1
  Uniprot ID: Q9NS73
  ENST ID: ENST00000416007
  CDS Start-End: 89-1123
tcgccaagcgactaaagctggaagggagggggcggggttgtgagcaaatcttggtggtggtggtggtggggcggcctgagaagatatcatggctgctgccacggagcttaatcgcccgagcagcggtgacaggaacctggagcgaagatgcagacccaacctctcccgagaggtgctctacgaaatctttcgctccctacacaccctggttggacagcttgacctcagagatgatgtggtgaaaattacaatcgattggaacaagctccagagcctctcggcattccagcctgcattgctctttagtgcacttgaacaacacattttatatttacagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaaattgacagacgaatatctgcatttattgaaagaaagcaagctgaaatcaatgaaaacaacgtcagggaattttgcaatgttattgattgtaatcaagaaaatagttgtgcaagaactgatgcgatttttaccccttaccccggatttaaaagtcacgtaaaagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacagacaggtggtccagtgccaagagacatttatcagagaattaaaaaacttgaggataaaatccttgaattggaaggcatctctcctgaatattttcagtctgtaagcttttctggaaaaagaagaaaagttcaaccacctcaacagaactattcactggctgaacttgatgagaaaattagtgccctcaaacaagccctcctcagaaaatcaagagaagcagaatccatggcaacccaccaccttccatgaaaaactcctctcatccttgtcattttacttttttgtatacatatgtgtaacttacactgttattaattcaacggatatatatttatcaatgtagacttctctgtgaagtcaaggtttattttcacatgagtccagcttgcagcaagtaatcttcaaatattccagtaagttttgaaataatgaatgcattgaaaatagcattgttggaatttattcccttctgttttaaaggaggtattttggaaattgaaaaacttaatttacaagtgctggtacatcttttttcttttgtggaccacaggaaggaagatttattttgatattgatactttaaaaggactttatatttgtaacattgatgttaaccagtttattagtttaaatcagtactttgcatataataagcattcaacaaaaatttattgactgaaatgaattttaaatgcatgtgtatgaacttgtttttcttaatctttaagatgtcagtattcatgtaaataaacaatagatccagctttatccctt

SEQ ID NO: 151679 - DNA, 952 bp, Homo sapiens
  Payload ID: 9852
  Gene Symbol: MBIP
  Gene Name: MAP3K12 binding inhibitory protein 1
  ENST ID: ENST00000605579
  CDS Start-End: 1-898
cacggagcttaatcgcccgagcagcggtgacaggaacctggagcgaagatgcagacccaacctctcccgagaggtgctctacgaaatctttcgctccctacacaccctggttggacagcttgacctcagagatgatgtggtgaaaattacaatcgattggaacaagctccagagcctctcggcattccagcctgcattgctctttagtgcacttgaacaacacattttatatttacagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaaattgacagacgaatatctgcatttattgaaagaaagcaagctgaaatcaatgaaaacaacgtcagggaattttgcaatgttattgattgtaatcaagaaaatagttgtgcaagaactgatgcgatttttaccccttaccccggatttaaaagtcacgtaaaagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacagacaggtggtccagtgccaagagacatttatcagagaattaaaaaacttgaggataaaatccttgaattggaaggcatctctcctgaatattttcagtctgtagtgagtataagtgtcttttaaaaataaatgaaaatgttattgtattctggattctttgtggtttaacagtcactc

SEQ ID NO: 151680 - DNA, 853 bp, Homo sapiens
  Payload ID: 9852
  Gene Symbol: MBIP
  Gene Name: MAP3K12 binding inhibitory protein 1
  ENST ID: ENST00000604336
  CDS Start-End: 10-853
gaagatatcatggctgctgccacggagcttaatcgcccgagcagcggtgacaggaacctggagcgaagatgcagacccaacctctcccgagaggtgctctacgaaatctttcgctccctacacaccctggttggacagcttgacctcagagatgatgtggtgaaaattacaatcgattggaacaagctccagagcctctcggcattccagcctgcattgctctttagtgcacttgaacaacacattttatatttacagatggaattgtgttgttctcagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaaattgacagacgaatatctgcatttattgaaagaaagcaagctgaaatcaatgaaaacaacgtcagggaattttgcaatgttattgattgtaatcaagaaaatagttgtgcaagaactgatgcgatttttaccccttaccccggatttaaaagtcacgtaaaagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacagacaggtggtccagtgccaagagacatttatcagagaa

SEQ ID NO: 151681 - DNA, 702 bp, Homo sapiens
  Payload ID: 9852
  Gene Symbol: MBIP
  Gene Name: MAP3K12 binding inhibitory protein 1
  ENST ID: ENST00000603139
  CDS Start-End: 37-702
ggtggtggtggtggtggggcggcctgagaagatatcatggctgctgccacggagcttaatcgcccgagcagcggtgacaggaacctggagcgaagatgcagacccaacctctcccgagaggtgctctacgaaatctttcgctccctacacaccctggttggacagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaaattgacagacgaatatctgcatttattgaaagaaagcaagctgaaatcaatgaaaacaacgtcagggaattttgcaatgttattgattgtaatcaagaaaatagttgtgcaagaactgatgcgatttttaccccttaccccggatttaaaagtcacgtaaaagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacag

SEQ ID NO: 151682 - DNA, 621 bp, Homo sapiens
  Payload ID: 9852
  Gene Symbol: MBIP
  Gene Name: MAP3K12 binding inhibitory protein 1
  ENST ID: ENST00000604160
  CDS Start-End: 284-621
atttaactattaactagtttaactggctgataaatcgcttttgcagaaatgtcatagtaaaattggttttaaattgaaatgggcttcttcgatcaagtcactgtttcgtttcatggtgtaaaattcaagttttaaatgagaaacaatttaaaagtatgcttgtttacctgccttttaaaaggaaatattttctatcttacatagaccattttctagccgtaaaagtttgttttggggctggtactagcgcaagtggacaaagcaggcatttgtgtcaaagataatgcttgacctcagagatgatgtggtgaaaattacaatcgattggaacaagctccagagcctctcggcattccagcctgcattgctctttagtgcacttgaacaacacattttatatttacagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctgg

SEQ ID NO: 151683 - DNA, 1809 bp, Homo sapiens
  Payload ID: 9852
  Gene Symbol: MBIP
  Gene Name: MAP3K12 binding inhibitory protein 1
  ENST ID: ENST00000621657
  CDS Start-End: 37-933
ggtggtggtggtggtggggcggcctgagaagatatcatggctgctgccacggagcttaatcgcccgagcagcggtgacaggaacctggagcgaagatgcagacccaacctctcccgagaggtgctctacgaaatctttcgctccctacacaccctggttggacagcttgacctcagagatgatgtggtgaaaattacaatcgattggaacaagctccagagcctctcggcattccagcctgcattgctctttagtgcacttgaacaacacattttatatttacagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaaattgacagacgaatatctgcatttattgaaagaaagcaagctgaaatcaatgaaaacaacgtcagggaattttgcaatgttattgattgtaatcaagaaaatagttgtgcaagaactgatgcgatttttaccccttaccccggatttaaaagtcacgtaaaagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacagacaggtggtccagtgccaagagacatttatcagagaattaaaaaacttgaggataaaatccttgaattggaaggcatctctcctgaatattttcagtctgtaggcctgtgaacatacatgacacaagccctatgggaaagaagatttcatactcatcacccttctataataggatgaatgagccatctttaggaacctcacttggaatacagtcagctctaagagtgtccttgcaaacaggagaagttgagcacataccttacagaggacatagtacattattcatcaccctcaccatcatgctgggagtacatgcatgtagagcttttctggaaaaagaagaaaagttcaaccacctcaacagaactattcactggctgaacttgatgagaaaattagtgccctcaaacaagccctcctcagaaaatcaagagaagcagaatccatggcaacccaccaccttccatgaaaaactcctctcatccttgtcattttacttttttgtatacatatgtgtaacttacactgttattaattcaacggatatatatttatcaatgtagacttctctgtgaagtcaaggtttattttcacatgagtccagcttgcagcaagtaatcttcaaatattccagtaagttttgaaataatgaatgcattgaaaatagcattgttggaatttattcccttctgttttaaaggaggtattttggaaattgaaaaacttaatttacaagtgctggtacatcttttttcttttgtggaccacaggaaggaagatttattttgatattgatactttaaaaggactttatatttgtaacattgatgttaaccagtttattagtttaaatcagtactttgcatataataagcattcaacaaaaatttattgactgaaatgaattttaaatgcatgtgtatgaacttgtttttcttaatctttaagatgtcagtattcatgtaaataaacaatagatccagcttt

SEQ ID NO: 151684 - DNA, 1725 bp, Homo sapiens
  Payload ID: 9853
  Gene Symbol: MAP3K7CL
  Gene Name: MAP3K7 C-terminal like
  Uniprot ID: P57077
  ENST ID: ENST00000286791
  CDS Start-End: 1-729
atggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctggatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgac

SEQ ID NO: 151685 - DNA, 1855 bp, Homo sapiens
  Payload ID: 9853
  Gene Symbol: MAP3K7CL
  Gene Name: MAP3K7 C-terminal like
  Uniprot ID: P57077
  ENST ID: ENST00000341618
  CDS Start-End: 130-858
ccgagagcgagggagggctgtgaggactgccagcacgctgtcacctctcaatagcagcccaaacagattaagacatgggaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctggatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 151686 - DNA, 2066 bp, Homo sapiens
  Payload ID: 9853
  Gene Symbol: MAP3K7CL
  Gene Name: MAP3K7 C-terminal like
  Uniprot ID: P57077
  ENST ID: ENST00000339024
  CDS Start-End: 641-1069
gtccaagcccagtgctctttcccctgatgagaaacctttccagatttaaaccattaacaaccctctctaaagaggaggcaagaggtttcaatttcttctcagggaaaaaaagaactgacatcaaaaggtctgtgcggggtcatttgtctcatcatgactttgatttggccttgatctttatttagtatttcagttttatgctctgcaacaagtttggccatgttggaggacaatccaaaggtcagcaagttggctactggcgattggatgctcactctgaagccaaagtctattactgtgcccgtggaaatccccagctcccctctgggttgacattcgtaaccttcctggatcctatcagagaaaccttgttcatcatttcatttccaaattatgaagaccacctgggcctgactgaagatgcttgtttcttcctcttccctaacgccctttccaccagtgcggactgcagattgtcagtggctgctatgcagcaggtgcagcctggtctctcactgagtctctactccacaaaggcaacgactggccaaggcagtggctggctctgggttacacaagtgcagacactcaactaagtgagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 151687 - DNA, 692 bp, Homo sapiens
  Payload ID: 9853
  Gene Symbol: MAP3K7CL
  Gene Name: MAP3K7 C-terminal like
  Uniprot ID: P57077
  ENST ID: ENST00000399925
  CDS Start-End: 130-558
gatcagcagcaacttaaccaaagctctgttacagcctgtagccaagagaaggaacctgtggttcgtttccccagacggtgtgatgaaaagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgag

SEQ ID NO: 151688 - DNA, 749 bp, Homo sapiens
  Payload ID: 9853
  Gene Symbol: MAP3K7CL
  Gene Name: MAP3K7 C-terminal like
  Uniprot ID: P57077
  ENST ID: ENST00000399926
  CDS Start-End: 199-627
aaagatgacaacatcctggctgttagagagattgtcagtggctgctatgcagcaggtgcagcctggtctctcactgagtctctactccacaaaggcaacgactggccaaggcagtggctggctctgggttacacaagtgcagacactcaactaagtgagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaact

SEQ ID NO: 151689 - DNA, 1904 bp, Homo sapiens
  Payload ID: 9853
  Gene Symbol: MAP3K7CL
  Gene Name: MAP3K7 C-terminal like
  Uniprot ID: P57077
  ENST ID: ENST00000399928
  CDS Start-End: 479-907
cacgctgaagacattcctgtcttgtgaagcaagtctgtttgtattttaagtttgccaggactaatgaattaaaacatttggactccccacaacttgctgtttatcaatgcctctgacaggaggagggttttcttttgctcttgctttttctagaaagatgacaacatcctggctgttagagaggcaaggaaaggagagaggggttgtgaagggaagcggaagggaagggaagggaggtcccgtgggacgctggggtctggggcagagcaggtagcagcgtgctgccctgacagctgtctccgctcctcagattgtcagtggctgctatgcagcaggtgcagcctggtctctcactgagtctctactccacaaaggcaacgactggccaaggcagtggctggctctgggttacacaagtgcagacactcaactaagtgagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 151690 - DNA, 1964 bp, Homo sapiens
  Payload ID: 9853
  Gene Symbol: MAP3K7CL
  Gene Name: MAP3K7 C-terminal like
  Uniprot ID: P57077
  ENST ID: ENST00000399934
  CDS Start-End: 539-967
ccgagagcgagggagggctgtgaggactgccagcacgctgtcacctctcaatagcagcccaaacagattaagacatgggaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctggctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 151691 - DNA, 2093 bp, Homo sapiens
  Payload ID: 9853
  Gene Symbol: MAP3K7CL
  Gene Name: MAP3K7 C-terminal like
  Uniprot ID: P57077
  ENST ID: ENST00000399935
  CDS Start-End: 668-1096
ccgagagcgagggagggctgtgaggactgccagcacgctgtcacctctcaatagcagcccaaacagattaagacatgggaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctggattgtcagtggctgctatgcagcaggtgcagcctggtctctcactgagtctctactccacaaaggcaacgactggccaaggcagtggctggctctgggttacacaagtgcagacactcaactaagtgagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 151692 - DNA, 2003 bp, Homo sapiens
  Payload ID: 9853
  Gene Symbol: MAP3K7CL
  Gene Name: MAP3K7 C-terminal like
  Uniprot ID: P57077
  ENST ID: ENST00000399947
  CDS Start-End: 278-1006
atgtacaagggcagccgtggggctggcaacagcttcgtaatcctggcttcctgctttctgggtcaaagccctggtggtgtgttcttgatatcggtccatctagtggcgttgtttgattcctcccaccttgctgatcattcgtagtgtagcccccaaggtgtggaataacccttaagcccttaccggggtccttctggactgagaattgttgtaaagtaatactgctcaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctggatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 151693 - DNA, 577 bp, Homo sapiens
  Payload ID: 9853
  Gene Symbol: MAP3K7CL
  Gene Name: MAP3K7 C-terminal like
  ENST ID: ENST00000419845
  CDS Start-End: 445-577
gccccggttcctgcccgcacctctccctccacacctccccgcaagctgagggagccggctccggcctcggccagcccaggaaggcgctcccacagcgcagtggtgggctgaagggctcctcaagtgccgccaaagtgggagcccaggcagaggaggcgccgagagcgagggagggctgtgaggactgccagcacgctgtcacctctcaatagcagcccaaacagattaagacatgggagatgtacaagggcagccgtggggctggcaacagcttcgtaatcctggcttcctgctttctgggtcaaagccctggtggtgtgttcttgatatcggtccatctagtggcgttgtttgattcctcccaccttgctgatcattcgtagtgtagcccccaaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccag

SEQ ID NO: 151694 - DNA, 556 bp, Homo sapiens
  Payload ID: 9853
  Gene Symbol: MAP3K7CL
  Gene Name: MAP3K7 C-terminal like
  ENST ID: ENST00000451489
  CDS Start-End: 275-556
ctcttgtacttgatttcttggtgcgggaaagtgttgggggatttagccaaaagaggagtgcaactttccatccttagatgttatgctaaagtgattcggtgattgtacaatgcataacagtaaaacttttctttttagctaaaatgttaagggaattttaatggtttcttctgttgaatttgagacaatccatgccattccctaggtggctaacaaaatgcttgattctgagcagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaa

SEQ ID NO: 151695 - DNA, 1407 bp, Homo sapiens
  Payload ID: 9853
  Gene Symbol: MAP3K7CL
  Gene Name: MAP3K7 C-terminal like
  ENST ID: ENST00000545939
  CDS Start-End: 1-411
atgcttgtttcttcctcttccctaacgccctttccaccagtgcggactgcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgac

SEQ ID NO: 151696 - DNA, 2111 bp, Homo sapiens
  Payload ID: 9854
  Gene Symbol: MAP6D1
  Gene Name: MAP6 domain containing 1
  Uniprot ID: Q9H9H5
  ENST ID: ENST00000318631
  CDS Start-End: 32-631
cgggagcggggcggcgggcgccggggctggcatggcgtggccctgtatcagccgcctgtgctgcctggcgcggcgctggaaccagctggaccgctccgacgtggcggtgccgctcactctgcacggctactcggacctcgacagcgaggagccgggcacgggcggcgccgcctcgcgcaggggccagcctcccgcgggcgcccgggattccggccgggacgtgccgctcactcagtaccagcgggacttcggcttgtggaccacgcccgccgggcccaaggatccgccgccggggcgcggaccgggggcgggcggccgcaggggcaaatcctccgcgcagtcctccgcgccacctgcgcccggcgcccgcggggtctacgtgctgcccatcggcgacgcggacgcggctgcagcagtgaccacgtcgtacagacaggaattccaggcttggactggagtgaagccctcaagatccacaaagacaaaaccagcccgagtcatcacaacccacacttcgggatgggacagcagccctggggccggcttccaggtcccagaggtgaggaagaagttcactcctaacccctccgccatctttcaggcctcagctccccggattctcaacgtgtgactgcctgcaccgtgacaccatggctgccgacaggacagggctggggagcggcctcaggacccactgccgcggggctgggcgagagcatggcatgggcccctgcgggagggcacagcccctctcaaagctgtcaccagggccaaagtgctggtgtggagcagatgcaccgatggacttggcacacccagctcagcctcaagcatcctcttgagaagcctgtggaaggctcctgcgttcgttaactgccatctggccgtctctcagttttgaaatctctgaggagcctgaggatcaagtcagttgggaaccgaattggtccatggaagctgaggaatgtggacacatccggcccttgaaagaaccagttatgtccacttttggtggatttcccaggatgcgtgagcacttgattaatttcataacctacagtgagacccttggctcttcctacaaatggcccctgcagttgaagctgttggaatcttgggccgtcacctgcatgactcatggtgatgctgagtatccaggaggaaatttccagaagaaacagaccgtcagtcacgggcttccacttcacagacctccttatggccaagatgagcctcatgttttaacaaaacagttcttgggattgaatgactcacatttaccttgtgctaggttctaaagattgaatccacattttgttactaatgattttcccgctaacataaggatgatgagcagggcactatcatacacactggctgagaactggaactgtttttgggaaggtggcatttgtctcattccctgaaataccttaaaatgtcctctacaccaacccttccgtctaccctgctcacatgtacagtgacggggaactcaccaccttttgaagaggcagttcattttctttgcaaagctctctcctaacttcctccgtaaattccagccagcatggccacatgggtcacgcctggtgccttcacacgtttgaggggtcttcgtctctttttaaagcttagaggtacaagctcaggacagtcttcagtaaggaaatttgtggatttccctttggatctttcttcctctccagcccacaagtggctctagtgagacgagcatttaagctgcaggtggtggcactcgggtctcagagccaccagacgtgcaggtgggacagtggttccagctccgactgcctgtcagcgtccctcccaggtgctagccctggcaggcacagccctcccctcatgccagcaaaggaaatgctcttgatgagaggctcgctttaaagaagcccaaagcgtgtgcttatccaaggggttcagctattcctgacttcacggcttgcatgtttgatttttctaagagaaaagaggctgcctgctgggtgtctgtggaaatgagattaaaaactgtacaatctcagattttactaaaatgcaaaaatgtagtttcagtttcttaaattataagcacgagtcttctcacgctt

SEQ ID NO: 151697 - DNA, 890 bp, Homo sapiens
  Payload ID: 9854
  Gene Symbol: MAP6D1
  Gene Name: MAP6 domain containing 1
  ENST ID: ENST00000431348
  CDS Start-End: 48-596
cgggagcgccgcgcgccgggagcggggcggcgggcgccggggctggcatggcgtggccctgtatcagccgcctgtgctgcctggcgcggcgctggaaccagctggaccgctccgacgtggcggtgccgctcactctgcacggctactcggacctcgacagcgaggagccgggcacgggcggcgccgcctcgcgcaggggccagcctcccgcgggcgcccgggattccggccgggacgtgccgctcactcagtaccagcgggacttcggcttgtggaccacgcccgccgggcccaaggatccgccgccggggcgcggaccgggggcgggcggccgcaggggcaaatcctccgcgcagtcctccgcgccacctgcgcccggcgcccgcggggtctacgtgctgcccatcggcgacgcggacgcggctgcagcagtgaccacgtcgtacagacaggaattccaggcttggactggagtgaagccctcaagatccacaaagacaaaaccagcccgagtcatcacaacccacacttcgggatgggacagcagccctggggccggcttccaggcctcagctccccggattctcaacgtgtgactgcctgcaccgtgacaccatggctgccgacaggacagggctggggagcggcctcaggacccactgccgcggggctgggcgagagcatggcatgggcccctgcgggagggcacagcccctctcaaagctgtcaccagggccaaagtgctggtgtggagcagatgcaccgatggacttggcacacccagctcagcctcaagcatcctcttgagaagcctgtggaaggctcctgcgttcgttaactgccatctggccgtctctcagttttgaaatctctgaggagcctgaggatca

SEQ ID NO: 151698 - DNA, 549 bp, Homo sapiens
  Payload ID: 9854
  Gene Symbol: MAP6D1
  Gene Name: MAP6 domain containing 1
  ENST ID: ENST00000445426
  CDS Start-End: 1-400
gtgctgcctggcgcggcgctggaaccagctggaccgctccgacgtggcggtgccgctcactctgcacggctactcggacctcgacagcgaggagccgggcacgggcggcgccgcctcgcgcaggggccagcctcccgcgggcgcccgggattccggccgggacgtgccgctcactcagtaccagcgggacttcggcttgtggaccacgcccgccgggcccaaggatccgccgccggggcgcggaccgggggcgggcggccgcaggggcaaatcctccgcgcagtcctccgcgccacctgcgcccggcgcccgcggggtctacgtgctgcccatcggcgacgcggacgcggctgcagcagtgaccacgtcgtacaggaattccaggcttggactggagtgaagccctcaagatccacaaagacaaaaccagcccgagtcatcacaacccacacttcgggatgggacagcagccctggggccggcttccaggtcccagaggtgaggaagaagttcactcctaacccctccgccatctttcaggcctcagct

SEQ ID NO: 151699 - DNA, 3456 bp, Homo sapiens
  Payload ID: 9855
  Gene Symbol: MAP7D1
  Gene Name: MAP7 domain containing 1
  Uniprot ID: Q3KQU3
  ENST ID: ENST00000316156
  CDS Start-End: 454-2865
gcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataattctgccaa

SEQ ID NO: 151700 - DNA, 3238 bp, Homo sapiens
  Payload ID: 9855
  Gene Symbol: MAP7D1
  Gene Name: MAP7 domain containing 1
  Uniprot ID: Q3KQU3
  ENST ID: ENST00000373150
  CDS Start-End: 221-2647
gaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccaggccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataattctgccaa

SEQ ID NO: 151701 - DNA, 3324 bp, Homo sapiens
  Payload ID: 9855
  Gene Symbol: MAP7D1
  Gene Name: MAP7 domain containing 1
  Uniprot ID: Q3KQU3
  ENST ID: ENST00000373151
  CDS Start-End: 217-2742
gggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagcagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 151702 - DNA, 959 bp, Homo sapiens
  Payload ID: 9855
  Gene Symbol: MAP7D1
  Gene Name: MAP7 domain containing 1
  ENST ID: ENST00000429533
  CDS Start-End: 227-959
acaagcgcagaatgccggagcaagggcggcagcaaggctcccagacctgtccccagcccagccatcagcaggggagagaaagcgaaaccctttcaggggtctccttgtgactctccttcatgcctcccgacgtcccccgggccgctttggtttagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaa

SEQ ID NO: 151703 - DNA, 567 bp, Homo sapiens
  Payload ID: 9855
  Gene Symbol: MAP7D1
  Gene Name: MAP7 domain containing 1
  ENST ID: ENST00000530729
  CDS Start-End: 148-567
acagaagtaaatctgcttctcctgcctgccctccttcccagcctctctgggccccaatctcccactagagaatgagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccgg

SEQ ID NO: 151704 - DNA, 744 bp, Homo sapiens
  Payload ID: 9855
  Gene Symbol: MAP7D1
  Gene Name: MAP7 domain containing 1
  ENST ID: ENST00000530975
  CDS Start-End: 1-744
ggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagca

SEQ ID NO: 151705 - DNA, 3918 bp, Homo sapiens
  Payload ID: 9856
  Gene Symbol: MAP7D2
  Gene Name: MAP7 domain containing 2
  Uniprot ID: Q96T17
  ENST ID: ENST00000379643
  CDS Start-End: 39-2360
cgggcttggcagtgcgcctgtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggaacggctggaggcgatgatgcgccggtccctggagcgcacacagcagctggagctgaaaaagaagtattcgtggggagcaccactggccattggacccggaggacatgatgcatgtgacaaactttcaacatcaactatgagtttgccaaagccaacggagcctcccatgaataaacgcctgtcttcatccaccgtggcaatatcctattccccagaccgagctcatcacatgcaccttagtccaatggaagccattcttgtttcgcgactgttgacacccacacagtcttctttagccagaagcagagcttcagtcatgctctctgggcaggccaatgattcagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgactggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgtctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaagagtc

SEQ ID NO: 151706 - DNA, 3930 bp, Homo sapiens
  Payload ID: 9856
  Gene Symbol: MAP7D2
  Gene Name: MAP7 domain containing 2
  Uniprot ID: Q96T17
  ENST ID: ENST00000379651
  CDS Start-End: 20-2218
gtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggaacggctggaggcgatgatgcgccggtccctggagcgcacacagcagctggagctgaaaaagaagtattcgtggggagcaccactggccattggacccggaggacatgatgcatgtgacaaactttcaacatcaactatgagtttgccaaagccaacggagcctcccatgaataaacgcctgtcttcatccaccgtggcaatatcctattccccagaccgagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgactggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgtctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaagagtctgatgacttgctagcgttttattttttctgtaagctcaatgtgctgaaaccaaaccaggcttttaaaaacctgtgtagaagaaaaccaaaaaatcctgtgtgggtgtcctttccctgtcaaactcattaaaaattcctttgttgccagtgccaa

SEQ ID NO: 151707 - DNA, 2476 bp, Homo sapiens
  Payload ID: 9856
  Gene Symbol: MAP7D2
  Gene Name: MAP7 domain containing 2
  Uniprot ID: Q96T17
  ENST ID: ENST00000443379
  CDS Start-End: 26-2089
gcgcctgtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggaacggctggaggcgatgatgcgccggtccctggagcgcacacagcagctggagctgaaaaagaagtattcgtggggagcaccactggccattggacccggaggacatgatgctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgactggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgtctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtctttt

SEQ ID NO: 151708 - DNA, 2233 bp, Homo sapiens
  Payload ID: 9856
  Gene Symbol: MAP7D2
  Gene Name: MAP7 domain containing 2
  Uniprot ID: Q96T17
  ENST ID: ENST00000452324
  CDS Start-End: 105-2147
gagataaacgccctttccctggcccaggatcgtccggacgtgcatccaagggccgcacccctctctgtgcgagtggcggggttctttcttggggcgacctgggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggaacggctggaggcgatgatgcgccggtccctggagcgcacacagcagctggagctgaaaaagaagtattcgtggggagcaccactggccattggacccggaggacatgatgcatgtgacaaactttcaacatcaactatgagtttgccaaagccaacggagcctcccatgaataaacgcctgtcttcatccaccgtggcaatatcctattccccagaccgagctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgactggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgtctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaaga

SEQ ID NO: 151709 - DNA, 4567 bp, Homo sapiens
  Payload ID: 9857
  Gene Symbol: MAP7D3
  Gene Name: MAP7 domain containing 3
  Uniprot ID: Q8IWC1
  ENST ID: ENST00000316077
  CDS Start-End: 222-2852
agaccaggtagtcgctgcccagccggtcaggacgtgggacgcaaggggcaatcctgcccggttcgcaggtccgaggcgggcgcggtggcccttcgggccccgccccgccccgccccgccccgccccgcccaccggcagcccggccacgacccaagcggaggccgcgccgacgcctgcgcaatgtatgcggagagccaccaccgcctccggtcccgactccgatgatggcggacggcgccgcagctggcgctggcggcagcccatccttgagagagctgcgggcacggatggttgctgcagcaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcgcagagaggagaaaaggagacagcaagacgccaataaagaaacacaactacttgaaaaagaaagaaagaccaagctccaatatgaaaaacagatggaggaaagacagagaaagctgaaggagcgaaaagagaaagaagaacaacggagaatagctgcagaagaaaaaagacaccagaaggatgaagcacaaaaggaaaaatttacagccattctttatcgtactttggaacggaggagacttgctgatgattatcagcaaaaaagatggtcatggggaggctctgcaatggcgaattctgagagcaaaactgccaataaacgatctgcatctactgaaaaacttgaacagggtacttctgctttaatcagacaaatgcctttgtcatctgcaggccttcaaaattccgttgccaaaaggaaaacagacaaggagagaagctcatctttaaatagaagagatagtaacctacattcgtctactgataaagaacaagccgaaaggaagccacgtgttacaggcgtcaccaattatgtaatgcagtatgtcactgtacccttgcgtaaatgtactagcgacgaattgagggctgttatgtttcccatgtcgacaatgaaaatacctcctcaaacaaaagtagaagagtctcccttggagaaagtagagacacctcccaaggcaagtgtggatgcacccccccaggtgaatgtggaagtattctgcaacacaagcatggaagcgtcccccaaggcaggtgtgggcatggcccctgaggtgagcacggactcattccctgtggtgagcgtggacgtgtcgcctgtggtgagcacatatgattctgagatgagcatggacgcatcccccgagttgagcatagaagcactcccgaaggtggacctggaaacagttcccaaggtgagcatagtagcatccccggaggcgagcctggaagcacccccggaagtgagtctggaagcactgccagaggtgagcgtggaagcagccccagaggggagcctggaagcacctcccaaggggagcgcagaagtagcccccaaggagagtgtgaaagggtcacccaaggagagcatggaggcatctcctgaggcgatggtgaaagcatcccccaagacatcccttgaagcaagcatggaagcatctcccaaggcaaaagcgagagacgctccaaagaaatcagaaatggacaaacaggccttaatccctattgccaagaagcgtctatcatcatacactgagtgttataaatggtcatcatctcctgaaaatgcttgtggtctgccgtctcccatcagcactaacaggcaaatccaaaagaactgccctccatcaccattaccacttatttcaaaacagtcaccacagacttcttttccttataaaataatgcctattcaacacaccctgtctgtgcaaagtgcatcaagtactgtcaaaaagaaaaaagaaacagtttctaaaaccactaacagatgtgaggctttgagccaaaggcatatgatctatgaagagtctggtaataagagtactgcaggtattatgaatgccgaggcggcaacaaaaattttgacagaattgcgccgccttgctcgtgaacaaagagaaaaagaggaagaagaaagacaacgggaagaaatgcagcaaagggtcattaagaaatcaaaagacatggcaaaggaagcagttggaggccaagcagaagaccacttgaaactcaaagatgggcagcaacaaaatgagactaaaaagaagaaaggatggctggatcaggaagaccaggaagcaccactgcagaaaggggacgccaaaataaaagctcaagaggaagctgacaaacgcaagaaagaacacgagagaattatgttacaaaatttacaagaacggttagaaaggaaaaagagaatagaagaaattatgaagcggacaagaaagacagatgtgaatgcctcaaaggtcacagaaacatccagccatgacatatatgaagaggctgaggctgacaacgaagaaagcgacaaggactcattgaatgaaatgtttccatcagccattctaaatggcacaggctcacctaccaaatttaaaatgccgttcaacaatgccaagaaaatgacacacaagctggtatttctagaagatggtaccagccaggtccgtaaagagccaaaaacatattttaatggcgatttgaaaaacttcagacaaaaaagcatgaaagacacttcaatacaggaagtagtttcaagaccatcttccaaaagaatgaccagtcacacaacgaaaaccagaaaggcggatgaaaccaacaccaccagcagatcctctgcacaaacaaaatctgaaggattccatgacatcttgccaaagtcctcagacacctttagacaataagagaagaagcaaacctgtttctcctcatttggatatgtaaaccttactcagcctgggagatgaatacatcttccactctggataactcaactcctgggcccatcagtcctcaaatttttctgcttctgacttgaacctggtaaaggaagtgacaccgaaaaattgaaagaaactgtcaaaaggccactttgatgtatatctcagatgttaaagtcatcttattctcttgtgtctaagcaagagttctaagtaaagagtggtttttgttttctttggaaaatcatcattgtctctcattcttgtgttgtcccaccaatgtgtttgctggagtgagtgcatcaaggatgctttcctgaaactgtaactgtggagtttctagaagaatctgattgcagaactaattctctttcagtatatatttgaaatcttaaagtaatgctttttctttttctttttcttttttttttttttgagacggagtcttgccctgtcgcccaggctgcagtgcagtggcacaatctcggctcactgcaacctccgcctcctcatctcaagcaattctcctgtctcagcctccccagtagctgggattacaggcatgtgccaccacacctggctaatttttttgtattttagtagagatagggttttaccatgttcaccaggctagtctcgaaatcctggcctcaagagatccacccgtcttggcctcccaaagtgttgggattacaggtgtgagccactgcacccagccaagtaatgctttttctgtgtaccagtgacaattttgacagctaaaaactcacagttgatcttgtagagaacagaatagattatgcaagggccgcaggatcgctcacaagagctgtcagattgtttctaatataaaaataccaaaggttgcaaaatccagcaaattgtattttactgtgatatatgtatatttttaactctacccatctgtgccagtgagtacacaggcactaataacctgaaatgctgggagtcctgtaaagccccatcttggaacagtcagcacctttcatgctcttgtcagtgtttccttttgaaggacatattggtgtttatctacagaaacatatattatttttattgtgtacataaaggagtatatggctgttgtcccgtggggtatgtttaattcctctaaatgtttaaagtacttttctgcctgtactctccagttctgtcgttgagtatacactcaggcttgagatacaaccaaaatttgcttgcctttctctagccactggctgccagtgagttcgtgtgatgggcacacagaaatgcacacagatgtacatacacgtatgtatgcacacacagtatatgattccataaaattcaaatgcagattaattctcctaatgagttttcagtgttgaatcgtaaatagtctgaagcaggccagtgttccttttggctgccagtcttggattagtaaaaggaggtaattctttcagattccctggttctttgccactcagagtattgtacttttgatatagaatagagaaggttacctttggtttaaaaactatttttatatactagctctttcatgtataaaacagagacaatcatcctaacaaaagagttcctgttatttttctgcacaaatgtcttgtgttgaaacactgttacagttccatataaatgtgtgctatataaaataaactttggagataaaacaa

SEQ ID NO: 151710 - DNA, 2432 bp, Homo sapiens
  Payload ID: 9857
  Gene Symbol: MAP7D3
  Gene Name: MAP7 domain containing 3
  ENST ID: ENST00000370660
  CDS Start-End: 25-2432
ccaccgcctccggtcccgactccgatgatggcggacggcgccgcagctggcgctggcggcagcccatccttgagagagctgcgggcacggatggttgctgcagcaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcgcagagaggagaaaaggagacagcaagacgccaataaagaaacacaactacttgaaaaagaaagaaagaccaagctccaatatgaaaaacagatggaggaaagacagagaaagctgaaggagcgaaaagagaaagaagaacaacggagaatagctgcagaagaaaaaagacaccagaaggatgaagcacaaaaggaaaaatttacagccattctttatcgtactttggaacggaggagacttgctgatgattatcagcaaaaaagatggtcatggggaggctctgcaatggcgaattctgagagcaaaactgccaataaacgatctgcatctactgaaaaacttgaacagggtacttctgctttaatcagacaaatgcctttgtcatctgcaggccttcaaaattccgttgccaaaaggaaaacagacaaggagagaagctcatctttaaatagaagagatagtaacctacattcgtctactgataaagaacaagccgaaaggaagccacgtgtagaagagtctcccttggagaaagtagagacacctcccaaggcaagtgtggatgcacccccccaggtgaatgtggaagtattctgcaacacaagcatggaagcgtcccccaaggcaggtgtgggcatggcccctgaggtgagcacggactcattccctgtggtgagcgtggacgtgtcgcctgtggtgagcacatatgattctgagatgagcatggacgcatcccccgagttgagcatagaagcactcccgaaggtggacctggaaacagttcccaaggtgagcatagtagcatccccggaggcgagcctggaagcacccccggaagtgagtctggaagcactgccagaggtgagcgtggaagcagccccagaggggagcctggaagcacctcccaaggggagcgcagaagtagcccccaaggagagtgtgaaagggtcacccaaggagagcatggaggcatctcctgaggcgatggtgaaagcatcccccaagacatcccttgaagcaagcatggaagcatctcccaaggcaaaagcgagagacgctccaaagaaatcagaaatggacaaacaggccttaatccctattgccaagaagcgtctatcatcatacactgagtgttataaatggtcatcatctcctgaaaatgcttgtggtctgccgtctcccatcagcactaacaggcaaatccaaaagaactgccctccatcaccattaccacttatttcaaaacagtcaccacagacttcttttccttataaaataatgcctattcaacacaccctgtctgtgcaaagtgcatcaagtactgtcaaaaagaaaaaagaaacagtttctaaaaccactaacagatgtgaggctttgagccaaaggcatatgatctatgaagagtctggtaataagagtactgcaggtattatgaatgccgaggcggcaacaaaaattttgacagaattgcgccgccttgctcgtgaacaaagagaaaaagaggaagaagaaagacaacgggaagaaatgcagcaaagggtcattaagaaatcaaaagacatggcaaaggaagcagttggaggccaagcagaagaccacttgaaactcaaagatgggcagcaacaaaatgagactaaaaagaagaaaggatggctggatcaggaagaccaggaagcaccactgcagaaaggggacgccaaaataaaagctcaagaggaagctgacaaacgcaagaaagaacacgagagaattatgttacaaaatttacaagaacggttagaaaggaaaaagagaatagaagaaattatgaagcggacaagaaagacagatgtgaatgcctcaaaggtcacagaaacatccagccatgacatatatgaagaggctgaggctgacaacgaagaaagcgacaaggactcattgaatgaaatgtttccatcagccattctaaatggcacaggctcacctaccaaatttaaaatgccgttcaacaatgccaagaaaatgacacacaagctggtatttctagaagatggtaccagccaggtccgtaaagagccaaaaacatattttaatggcgatttgaaaaacttcagacaaaaaagcatgaaagacacttcaatacaggaagtagtttcaagaccatcttccaaaagaatgaccagtcacacaacgaaaaccagaaa

SEQ ID NO: 151711 - DNA, 4365 bp, Homo sapiens
  Payload ID: 9857
  Gene Symbol: MAP7D3
  Gene Name: MAP7 domain containing 3
  Uniprot ID: Q8IWC1
  ENST ID: ENST00000370661
  CDS Start-End: 14-2539
ggtcccgactccgatgatggcggacggcgccgcagctggcgctggcggcagcccatccttgagagagctgcgggcacggatggttgctgcagcaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcgcagagaggagaaaaggagacagcaagacgccaataaagaaacacaactacttgaaaaagaaagaaagaccaagctccaatatgaaaaacagatggaggaaagacagagaaagctgaaggagcgaaaagagaaagaagaacaacggagaatagctgcagaagaaaaaagacaccagaaggatgaagcacaaaaggaaaaatttacagccattctttatcgtactttggaacggaggagacttgctgatgattatcagcaaaaaagatggtcatggggaggctctgcaatggcgaattctgagagcaaaactgggaaaacagacaaggagagaagctcatctttaaatagaagagatagtaacctacattcgtctactgataaagaacaagccgaaaggaagccacgtgttacaggcgtcaccaattatgtaatgcagtatgtcactgtacccttgcgtaaatgtactagcgacgaattgagggctgttatgtttcccatgtcgacaatgaaaatacctcctcaaacaaaagtagaagagtctcccttggagaaagtagagacacctcccaaggcaagtgtggatgcacccccccaggtgaatgtggaagtattctgcaacacaagcatggaagcgtcccccaaggcaggtgtgggcatggcccctgaggtgagcacggactcattccctgtggtgagcgtggacgtgtcgcctgtggtgagcacatatgattctgagatgagcatggacgcatcccccgagttgagcatagaagcactcccgaaggtggacctggaaacagttcccaaggtgagcatagtagcatccccggaggcgagcctggaagcacccccggaagtgagtctggaagcactgccagaggtgagcgtggaagcagccccagaggggagcctggaagcacctcccaaggggagcgcagaagtagcccccaaggagagtgtgaaagggtcacccaaggagagcatggaggcatctcctgaggcgatggtgaaagcatcccccaagacatcccttgaagcaagcatggaagcatctcccaaggcaaaagcgagagacgctccaaagaaatcagaaatggacaaacaggccttaatccctattgccaagaagcgtctatcatcatacactgagtgttataaatggtcatcatctcctgaaaatgcttgtggtctgccgtctcccatcagcactaacaggcaaatccaaaagaactgccctccatcaccattaccacttatttcaaaacagtcaccacagacttcttttccttataaaataatgcctattcaacacaccctgtctgtgcaaagtgcatcaagtactgtcaaaaagaaaaaagaaacagtttctaaaaccactaacagatgtgaggctttgagccaaaggcatatgatctatgaagagtctggtaataagagtactgcaggtattatgaatgccgaggcggcaacaaaaattttgacagaattgcgccgccttgctcgtgaacaaagagaaaaagaggaagaagaaagacaacgggaagaaatgcagcaaagggtcattaagaaatcaaaagacatggcaaaggaagcagttggaggccaagcagaagaccacttgaaactcaaagatgggcagcaacaaaatgagactaaaaagaagaaaggatggctggatcaggaagaccaggaagcaccactgcagaaaggggacgccaaaataaaagctcaagaggaagctgacaaacgcaagaaagaacacgagagaattatgttacaaaatttacaagaacggttagaaaggaaaaagagaatagaagaaattatgaagcggacaagaaagacagatgtgaatgcctcaaaggtcacagaaacatccagccatgacatatatgaagaggctgaggctgacaacgaagaaagcgacaaggactcattgaatgaaatgtttccatcagccattctaaatggcacaggctcacctaccaaatttaaaatgccgttcaacaatgccaagaaaatgacacacaagctggtatttctagaagatggtaccagccaggtccgtaaagagccaaaaacatattttaatggcgatttgaaaaacttcagacaaaaaagcatgaaagacacttcaatacaggaagtagtttcaagaccatcttccaaaagaatgaccagtcacacaacgaaaaccagaaaggcggatgaaaccaacaccaccagcagatcctctgcacaaacaaaatctgaaggattccatgacatcttgccaaagtcctcagacacctttagacaataagagaagaagcaaacctgtttctcctcatttggaaatcccattcctccttgtgtctcatctgagctggaaactcttcactgccaagtctggcgccaggtcctgttgatccatccattgaaactgtctaccaggatgttcctgtttacaaggccaaggtgatggacactgacctagctttcccctcacgcattgctgcctcgcatttcccttcctggtatcctctacccggagggacagacccctggcctctaccagcagattctgcagatcagcgcattttctacgcctgtgtcattgtggacactgcatgtggaatgaagttttttaacagctccaatccctaaaaaccacaagaatgcagtgtgaaataccataaagaatgccagacaggcccctgaagacctgaacccagctgagagggctgctagctcacgtgtgacattgtgcacgttgttgctcttctctgatccctgttccttgtctgtcaaatgagggggctgtgctacaatctctgcagccttttcagttttgagactccactgttctcaaacacctctaactccttggagccagagcaagagggatcaggaggcataaaacagcagcgatggccaaggagccagagcgtggaggcggactgtgcatgacattttatcatgtcagggggcaattccctgtcattttcagtgaccccacccctccagtgcctggccggcctggttggtcaaaacaggccccgaaacagcctccttgcctttggtctccttaccagtccagttacagtgtttccagatgggtcctaggcacccatctgattctaatttccccaactgtattgtaatcattgcagttaggtttacatgtgcaatatgcaaggtacttgataggcattttctttttgtttttttgagatggagtctcgctctgttgcccaggctggaatgcagtggcgtgatcttgactcactgcaacctctgcctcccaggtttaaggggttcatctgcctcagcctcctgagtagctgggactacaggcacacaccacaacacttggctaatttgtgtatttttagtagagacagggtttcaccatgttggccaggctggtctcgaactcctgacctcaggtgatctgcctgcctcagcctcccaaagtgctgggattacaggcatgagccaccgtgcccagccaggcattttcaatgctcacaacaactctatgaggtgtgggtattcatttatgcctatgaggacactgaaatttgtggagagcagcatttgttccaggtcacacagctggaaagagacagagctgatattcaaacccaagtttgtccctcaaactaacaccccacactgctttgggagtggacatagtgtcttgaggcttgcagggtatgtcacagacaccagagcagtgtctttggtgctgggaatgaaatgtttgttggcatttagtgtgtttactgggtgccagtcccctcactaagcacctgcattatgtctcccacatgggattctgcaaagtagaaattttacgtctcacaggtgaaggatcaagctcagagaggttaacttgcccacagtctcatgactacaaagtggcagagcagccaggatttgaaccctggtagcctggtgccagagcccaccctgttaaccacaagcagagaggttcttgatattctgatcccattaattatgagggagaaaatgtttctctgctgacaaattgttaaggggaaatttaccctcatttctcctgagccttaggggtgtcactcttaaaatcgcatattcaacaaacaaatgccttctaagtactga

SEQ ID NO: 151712 - DNA, 4446 bp, Homo sapiens
  Payload ID: 9857
  Gene Symbol: MAP7D3
  Gene Name: MAP7 domain containing 3
  Uniprot ID: Q8IWC1
  ENST ID: ENST00000370663
  CDS Start-End: 164-2740
aaaaggaaatggtacagagcagcctgttgaaattagacagcagggtcaccctggtcctctgtgccacaggaaggaggggtactgaagtgtcagttgttggtgggggagcagtgctgcagtgggaattccagagctgagaaggctgccatcaaccaagtgagacatgaccagcccccgagttgctgcagcaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcgcagagaggagaaaaggagacagcaagacgccaataaagaaacacaactacttgaaaaagaaagaaagaccaagctccaatatgaaaaacagatggaggaaagacagagaaagctgaaggagcgaaaagagaaagaagaacaacggagaatagctgcagaagaaaaaagacaccagaaggatgaagcacaaaaggaaaaatttacagccattctttatcgtactttggaacggaggagacttgctgatgattatcagcaaaaaagatggtcatggggaggctctgcaatggcgaattctgagagcaaaactgccaataaacgatctgcatctactgaaaaacttgaacagggtacttctgctttaatcagacaaatgcctttgtcatctgcaggccttcaaaattccgttgccaaaaggaaaacagacaaggagagaagctcatctttaaatagaagagatagtaacctacattcgtctactgataaagaacaagccgaaaggaagccacgtgttacaggcgtcaccaattatgtaatgcagtatgtcactgtacccttgcgtaaatgtactagcgacgaattgagggctgttatgtttcccatgtcgacaatgaaaatacctcctcaaacaaaagtagaagagtctcccttggagaaagtagagacacctcccaaggcaagtgtggatgcacccccccaggtgaatgtggaagtattctgcaacacaagcatggaagcgtcccccaaggcaggtgtgggcatggcccctgaggtgagcacggactcattccctgtggtgagcgtggacgtgtcgcctgtggtgagcacatatgattctgagatgagcatggacgcatcccccgagttgagcatagaagcactcccgaaggtggacctggaaacagttcccaaggtgagcatagtagcatccccggaggcgagcctggaagcacccccggaagtgagtctggaagcactgccagaggtgagcgtggaagcagccccagaggggagcctggaagcacctcccaaggggagcgcagaagtagcccccaaggagagtgtgaaagggtcacccaaggagagcatggaggcatctcctgaggcgatggtgaaagcatcccccaagacatcccttgaagcaagcatggaagcatctcccaaggcaaaagcgagagacgctccaaagaaatcagaaatggacaaacaggccttaatccctattgccaagaagcgtctatcatcatacactgagtgttataaatggtcatcatctcctgaaaatgcttgtggtctgccgtctcccatcagcactaacaggcaaatccaaaagaactgccctccatcaccattaccacttatttcaaaacagtcaccacagacttcttttccttataaaataatgcctattcaacacaccctgtctgtgcaaagtgcatcaagtactgtcaaaaagaaaaaagaaacagtttctaaaaccactaacagatgtgaggctttgagccaaaggcatatgatctatgaagagtctggtaataagagtactgcaggtattatgaatgccgaggcggcaacaaaaattttgacagaattgcgccgccttgctcgtgaacaaagagaaaaagaggaagaagaaagacaacgggaagaaatgcagcaaagggtcattaagaaatcaaaagacatggcaaaggaagcagttggaggccaagcagaagaccacttgaaactcaaagatgggcagcaacaaaatgagactaaaaagaagaaaggatggctggatcaggaagaccaggaagcaccactgcagaaaggggacgccaaaataaaagctcaagaggaagctgacaaacgcaagaaagaacacgagagaattatgttacaaaatttacaagaacggttagaaaggaaaaagagaatagaagaaattatgaagcggacaagaaagacagatgtgaatgcctcaaaggtcacagaaacatccagccatgacatatatgaagaggctgaggctgacaacgaagaaagcgacaaggactcattgaatgaaatgtttccatcagccattctaaatggcacaggctcacctaccaaatttaaaatgccgttcaacaatgccaagaaaatgacacacaagctggtatttctagaagatggtaccagccaggtccgtaaagagccaaaaacatattttaatggcgatttgaaaaacttcagacaaaaaagcatgaaagacacttcaatacaggaagtagtttcaagaccatcttccaaaagaatgaccagtcacacaacgaaaaccagaaaggcggatgaaaccaacaccaccagcagatcctctgcacaaacaaaatctgaaggattccatgacatcttgccaaagtcctcagacacctttagacaataagagaagaagcaaacctgtttctcctcatttggatatgtaaaccttactcagcctgggagatgaatacatcttccactctggataactcaactcctgggcccatcagtcctcaaatttttctgcttctgacttgaacctggtaaaggaagtgacaccgaaaaattgaaagaaactgtcaaaaggccactttgatgtatatctcagatgttaaagtcatcttattctcttgtgtctaagcaagagttctaagtaaagagtggtttttgttttctttggaaaatcatcattgtctctcattcttgtgttgtcccaccaatgtgtttgctggagtgagtgcatcaaggatgctttcctgaaactgtaactgtggagtttctagaagaatctgattgcagaactaattctctttcagtatatatttgaaatcttaaagtaatgctttttctttttctttttcttttttttttttttgagacggagtcttgccctgtcgcccaggctgcagtgcagtggcacaatctcggctcactgcaacctccgcctcctcatctcaagcaattctcctgtctcagcctccccagtagctgggattacaggcatgtgccaccacacctggctaatttttttgtattttagtagagatagggttttaccatgttcaccaggctagtctcgaaatcctggcctcaagagatccacccgtcttggcctcccaaagtgttgggattacaggtgtgagccactgcacccagccaagtaatgctttttctgtgtaccagtgacaattttgacagctaaaaactcacagttgatcttgtagagaacagaatagattatgcaagggccgcaggatcgctcacaagagctgtcagattgtttctaatataaaaataccaaaggttgcaaaatccagcaaattgtattttactgtgatatatgtatatttttaactctacccatctgtgccagtgagtacacaggcactaataacctgaaatgctgggagtcctgtaaagccccatcttggaacagtcagcacctttcatgctcttgtcagtgtttccttttgaaggacatattggtgtttatctacagaaacatatattatttttattgtgtacataaaggagtatatggctgttgtcccgtggggtatgtttaattcctctaaatgtttaaagtacttttctgcctgtactctccagttctgtcgttgagtatacactcaggcttgagatacaaccaaaatttgcttgcctttctctagccactggctgccagtgagttcgtgtgatgggcacacagaaatgcacacagatgtacatacacgtatgtatgcacacacagtatatgattccataaaattcaaatgcagattaattctcctaatgagttttcagtgttgaatcgtaaatagtctgaagcaggccagtgttccttttggctgccagtcttggattagtaaaaggaggtaattctttcagattccctggttctttgccactcagagtattgtacttttgatatagaatagagaaggttacctttggtttaaaaactatttttatatactagctctttcatgtataaaacagagacaatcatcctaacaaaagagttcctgttatttttctgcacaaatgtcttgtgttgaaacactgttacagttccatataaatgtgtgctatataaaataaactttggag

SEQ ID NO: 151713 - DNA, 5873 bp, Homo sapiens
  Payload ID: 9858
  Gene Symbol: MADD
  Gene Name: MAP-kinase activating death domain
  Uniprot ID: Q8WXG6
  ENST ID: ENST00000349238
  CDS Start-End: 166-4992
cccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaagtatttgggctaaatactctaatggagattgttactgaagccggccccgggagtggtgaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 151714 - DNA, 5990 bp, Homo sapiens
  Payload ID: 9858
  Gene Symbol: MADD
  Gene Name: MAP-kinase activating death domain
  Uniprot ID: Q8WXG6
  ENST ID: ENST00000311027
  CDS Start-End: 166-5109
cccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaagtatttgggctaaatactctaatggagattgttactgaagccggccccgggagtggtgaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgaattgtggaacaagcaccaggaagtgaaaaagcaaaaagctttggaaaaacagaggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggaagggacaaaggatccatgtgggaccagttagaggatgcagctatggagaccttttctataagcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 151715 - DNA, 6005 bp, Homo sapiens
  Payload ID: 9858
  Gene Symbol: MADD
  Gene Name: MAP-kinase activating death domain
  ENST ID: ENST00000342922
  CDS Start-End: 358-5124
gatttcagcgctaaggcgtcggcggtgcacctcacgtgcatgtgtagcatgccttggtttttcctttggcatctgaaaaaggcacaacctgaaagacctagaacccagtgtcggtccccaggccctttgggacaggaagagaagagccgtgtggccgcggggaggatgtcctgaggcggggctgtcctcgcggactgactggactccatctcccagcgggcgccgcggcgcggccacgcccccccactccccgcgcgcgcccggtggagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 151716 - DNA, 5942 bp, Homo sapiens
  Payload ID: 9858
  Gene Symbol: MADD
  Gene Name: MAP-kinase activating death domain
  Uniprot ID: Q8WXG6
  ENST ID: ENST00000395336
  CDS Start-End: 188-4933
ctggcgcccgctcggagcggcgccgcgctggggagcgactgacgccccgctgccgggggacgtcgggctgggcctggccagtcccccagagcttgggagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaagtatttgggctaaatactctaatggagattgttactgaagccggccccgggagtggtgaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgaattgtggaacaagcaccaggaagtgaaaaagcaaaaagctttggaaaaacagaggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggaagggacaaaggatccatgtgggaccagttagaggatgcagctatggagaccttttctataagcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcagttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 151717 - DNA, 4988 bp, Homo sapiens
  Payload ID: 9858
  Gene Symbol: MADD
  Gene Name: MAP-kinase activating death domain
  Uniprot ID: Q8WXG6
  ENST ID: ENST00000395344
  CDS Start-End: 156-4781
aggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaag

SEQ ID NO: 151718 - DNA, 5744 bp, Homo sapiens
  Payload ID: 9858
  Gene Symbol: MADD
  Gene Name: MAP-kinase activating death domain
  Uniprot ID: Q8WXG6
  ENST ID: ENST00000407859
  CDS Start-End: 166-4863
cccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaagtatttgggctaaatactctaatggagattgttactgaagccggccccgggagtggtgaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 151719 - DNA, 5823 bp, Homo sapiens
  Payload ID: 9858
  Gene Symbol: MADD
  Gene Name: MAP-kinase activating death domain
  Uniprot ID: Q8WXG6
  ENST ID: ENST00000402192
  CDS Start-End: 180-4943
cgctcggagcggcgccgcgctggggagcgactgacgccccgctgccgggggacgtcgggctgggcctggccagtcccccagagcttgggagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactcc

SEQ ID NO: 151720 - DNA, 5614 bp, Homo sapiens
  Payload ID: 9858
  Gene Symbol: MADD
  Gene Name: MAP-kinase activating death domain
  Uniprot ID: Q8WXG6
  ENST ID: ENST00000406482
  CDS Start-End: 166-4605
cccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcagttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 151721 - DNA, 1823 bp, Homo sapiens
  Payload ID: 9858
  Gene Symbol: MADD
  Gene Name: MAP-kinase activating death domain
  ENST ID: ENST00000405573
  CDS Start-End: 214-1533
attgcatctggggtagaattgtggaacaagcaccaggaagtgaaaaagcaaaaagctttggaaaaacagaggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggaagggacaaaggatccatgtgggaccagttagaggatgcagctatggagaccttttctataagcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggtaggtgcgagcggcagcacgaggctccctgtcgttccatctgtaagaaggaccaatgtccaagcccccagtacttccccagcaagcatgagagagggccctctggagctagagggagaactggagcagctggacccaggaaagaaaccccaggggagggcacagtgacgttggcgaccacctggcgctgtgaaggtgcaccagggagcccgtgggggaggctgggcaggagcgaggccaggtggccacgctgccccatccgttggactccacacagtgtgagtgggagcgtctcacttggcccttcccctgcagtgtctctgccttcctctattcccaggatatgcttctgcttggtggttttgctttgagagtctagactggccgatctccttgtgtctttctggtgtgcgtgcagcttgcgtgtgcgtgcgtgcgtgcctgcgtgcttgtgtgta

SEQ ID NO: 151722 - DNA, 5684 bp, Homo sapiens
  Payload ID: 9858
  Gene Symbol: MADD
  Gene Name: MAP-kinase activating death domain
  Uniprot ID: Q8WXG6
  ENST ID: ENST00000402799
  CDS Start-End: 166-4803
cccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgttggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 151723 - DNA, 437 bp, Homo sapiens
  Payload ID: 9858
  Gene Symbol: MADD
  Gene Name: MAP-kinase activating death domain
  ENST ID: ENST00000453571
  CDS Start-End: 212-437
aatagaggaggaagcctgcgatctttaggatccgcctccaggcccagaggagggagagtcacaaatgacagccttggccgtgagagggggcctcttcttactaacccccactgcgccatatggacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacct

SEQ ID NO: 151724 - DNA, 549 bp, Homo sapiens
  Payload ID: 9858
  Gene Symbol: MADD
  Gene Name: MAP-kinase activating death domain
  ENST ID: ENST00000428807
  CDS Start-End: 87-549
cccccgctgcccaggattggtaggctccaccgctcggcagccggcttccctgctcggacgccgagcaccgccaaagcgcggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattgggg

SEQ ID NO: 151725 - DNA, 580 bp, Homo sapiens
  Payload ID: 9858
  Gene Symbol: MADD
  Gene Name: MAP-kinase activating death domain
  ENST ID: ENST00000422579
  CDS Start-End: 176-580
tatagagataaaactgaatcctattacctgcaggtcctctactgggagcaagggaaaggagaaagcagtattttgaggatttgagagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagc

SEQ ID NO: 151726 - DNA, 711 bp, Homo sapiens
  Payload ID: 9858
  Gene Symbol: MADD
  Gene Name: MAP-kinase activating death domain
  ENST ID: ENST00000444117
  CDS Start-End: 303-711
aggctccaccgctcggcagccggcttccctgctcggacgccgagcaccgccaaagcgcgtgagtggggggtggggactgggggatggggagcccgtcaggaagtctcaggggccgattatcttgggaagtgactttcagaggaatccccatgtcgtcgaaacgggcgctatgaccccgtcgggtgagagtctctctgagcaacccaaacagaagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcag

SEQ ID NO: 151727 - DNA, 658 bp, Homo sapiens
  Payload ID: 9858
  Gene Symbol: MADD
  Gene Name: MAP-kinase activating death domain
  ENST ID: ENST00000634938
  CDS Start-End: 1-598
cggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggagcggaaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttccc

SEQ ID NO: 151728 - DNA, 1699 bp, Homo sapiens
  Payload ID: 9859
  Gene Symbol: MARCKSL1
  Gene Name: MARCKS-like 1
  Uniprot ID: P49006
  ENST ID: ENST00000329421
  CDS Start-End: 347-934
gtacccgaccgccagcgtcgcctgctgcgcaagtggggcctgcgagccaaccccgcctccgcccctcgattgggcgcgcatttaaatgtccggccccgccccgagctccgggcgcttatatataggcagctcggcgggcggcgggcggcattctggcgcggagcggagcggcggcgggcgcagctagcgggtcggccgcggagcggaggtgcagctcggcttcccccggcacccctccccctcgggcgccagccccacccctccgccggccgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtccctttagtggtgc

SEQ ID NO: 151729 - DNA, 825 bp, Homo sapiens
  Payload ID: 9860
  Gene Symbol: MZB1
  Gene Name: marginal zone B and B1 cell-specific protein
  Uniprot ID: Q8WU39
  ENST ID: ENST00000302125
  CDS Start-End: 59-628
cacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctca

SEQ ID NO: 151730 - DNA, 988 bp, Homo sapiens
  Payload ID: 9860
  Gene Symbol: MZB1
  Gene Name: marginal zone B and B1 cell-specific protein
  Uniprot ID: Q8WU39
  ENST ID: ENST00000417694
  CDS Start-End: 58-285
acacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagagactctgctcctatcctccccacctccccctaactgagcagcagtcctgaggccctgcctcccagtccctccttgttccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctcacttcttttctctgcaaaaggtgcttgtggggctgggagtgcagacattggtgtttctgctgatgtcccttgtgaaaaaaaaa

SEQ ID NO: 151731 - DNA, 1096 bp, Homo sapiens
  Payload ID: 9860
  Gene Symbol: MZB1
  Gene Name: marginal zone B and B1 cell-specific protein
  Uniprot ID: Q8WU39
  ENST ID: ENST00000503481
  CDS Start-End: 226-597
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaagcacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagtccctccttgttccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctcacttcttttctctgcaaaaggtgcttgtggggctgggagtgcagacattggtgtttctgctgatgtcccttgtgaaaaaaaaaaaaaaa

SEQ ID NO: 151732 - DNA, 636 bp, Homo sapiens
  Payload ID: 9860
  Gene Symbol: MZB1
  Gene Name: marginal zone B and B1 cell-specific protein
  ENST ID: ENST00000503351
  CDS Start-End: 1-181
gtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccaggcccatccttgagtccggactccctccccaaccctgacggggcggctttggctatgtgtacatggtgcaagtgcacacgtgtgagcgcctgcacatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcag

SEQ ID NO: 151733 - DNA, 681 bp, Homo sapiens
  Payload ID: 9860
  Gene Symbol: MZB1
  Gene Name: marginal zone B and B1 cell-specific protein
  ENST ID: ENST00000513389
  CDS Start-End: 40-270
caaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagctacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctca

SEQ ID NO: 151734 - DNA, 11417 bp, Homo sapiens
  Payload ID: 9861
  Gene Symbol: MKI67
  Gene Name: marker of proliferation Ki-67
  Uniprot ID: P46013
  ENST ID: ENST00000368653
  CDS Start-End: 196-8886
taccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtcttaaaa

SEQ ID NO: 151735 - DNA, 12678 bp, Homo sapiens
  Payload ID: 9861
  Gene Symbol: MKI67
  Gene Name: marker of proliferation Ki-67
  Uniprot ID: P46013
  ENST ID: ENST00000368654
  CDS Start-End: 377-10147
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtcttaaaa

SEQ ID NO: 151736 - DNA, 12490 bp, Homo sapiens
  Payload ID: 9861
  Gene Symbol: MKI67
  Gene Name: marker of proliferation Ki-67
  ENST ID: ENST00000617118
  CDS Start-End: 196-9963
taccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctt

SEQ ID NO: 151737 - DNA, 3221 bp, Homo sapiens
  Payload ID: 9862
  Gene Symbol: MARVELD1
  Gene Name: MARVEL domain containing 1
  Uniprot ID: Q9BSK0
  ENST ID: ENST00000285605
  CDS Start-End: 154-675
gaaaggaggagaggaagagaggactaagaggggagcaaggcgaggaggccgcggcgggcgcagcgggcacctgggccgtgctgcccccgcgagcaaggcgccgccattccgctgctcggggcgccgccgccgccgccaccgcgcccaggggccatgctcccgccgcccccgcgccagccgccgccccaggcgcgtgcggcccgcggcgcggtgcgcctgcagcggcccttcctgcgcagcccgctgggcgtgttgcggctgctgcagctgctggccggcgctgccttctggatcactatcgccaccagcaagtaccagggccccgtgcacttcgcgctcttcgtgtccgtgctcttctggctgctcaccctgggcctctacttcctcacgctgctgggcaagcacgagctggtccccgtgctgggctcgcgctggctcatggtcaacgtggcgcacgatgtgctggcggccgcgctctacggcgccgccaccggcatcatgagcgaccagatgcagcgccacagctactgcaacctcaaggattacccgctcccctgcgcctaccacgccttcctggcggccgccgtctgcggcggcgtctgccacggcctctacctgctttcggcgctctatggctgcgggcgtcgctgccagggcaagcaggaggtggcgtgaggccgcccgcgcccgccgcggccccgatcggggcgggggaatccccggagaccagcctccttaatcccttcccccgccgccgccccgcgcgggtgcgccctggcaccctctccctgccctccagcgtttccactgtcgcccgcgcccgggaaccctgacgctcagctcccgcccgacggcagcgccgccgccgcccagaatcccagcccagaatcccgaccgccgcgccggacgcgccgtctcccgggacaagcgcaggctgcgatccgaggggctgacacacactcgcagacgagccgccccgaggcgaaacctcgcggttcctcttcccttccctgctgagactaagacgtggacaggggccgcgcagatccgggggaggctcccaaattggaaccaggcttctggctgcccccttccctcccgccccgtggtcggaagagcactcccttccctggcccctcatccagcctccggtgctgtaaaacgcaggcgctgggccgcgggcggagctgaggacaggccttggctggtcccaggatgagcgacgagtttggttttagctggggattgtgctggcatcctgcgaagctcctcccagccggtctctctgtgctcggttgtcttggggtggggcccatccgccgaggtggggaccgataggagaagccggtgggttgtacccttacacttgtggagtctcctcttgcctctacctactccgcctttgtccttaaggtttttgcaggccagtgccaaacacacactaactgtcctggcctctccgtgacacaagtctcttcccagccttcctcacaggcttctgccgcccccctcatctccaccctcccccatatctgtttgcattaggagttccacgaccatggtggaatgttaaggtgaaccccaccccttcttacagatggggacccagagcctgctcttgggaacagccagagtaagattggaacccagacttgcagtccagcgctgtttgcattaaaagggtgggtgagtcaggacccctggctcaggagccgcctctcctaaaagagggtttcaaggccaaatgggtttgtcaacggtgctgtctccctttcttggagatgctcattagcttatcaaagactgagaagtcccgctgttacagaaataatttagtttgctgtattaactgctcctgggcctggagcagtattcccaccttaagattcccagcatccctgtgctgtcccggctctcattcatgccgaagggcccaacccattggctgtgttctgtttgaagatttggggggcgccttctctttcttccccagggaattctctagcagagggaggggacccaccccagtgaggaagtagattgctgcctctagccagagacctgaactggggaatttgaacattcctttacattgttggagaaatgaagccaaagttattcagatggttttcccaggctaaaggaaagtcacctgcaagagatcccggcactgatctggagcagctgacagggtgggtctcccttaccaaagagaagaaccactctctggcgctggggtgacctgctggctgggcctgtaaggtttccatgttgctgaggccatggagattcccagagctggtcacaccgaccgctctcagggcccgctgccctgggctggcaacaccattctggccttggcctgcagaagctttcagagtcttcactggcagtagggggagatggggagaggaatgatctctgcccagccccttcctttccaaaccatgcaatggaagagcccagatgggtgaagattgattttgccttaactcaagagaattcctgttctccttgtgctatgatttggacacaagattctggatacctggaacttagctgtgtactcctgtaccctaaacagtggatttgagttccagcgtttattcttttttccttttttcagatcaccatctaagttacatctttagctcaggtccatccttctcaagatctccttcttagccccccagcccctggtgctgtctgtggtcaggtgaccttactcaggagcagatatctccttggccgccatggagcctcatccatccacacgtgcctgtagcattccagagctcactgcccttctagatgtgccttcccgcttggcttccagcggcttgtgctcactctgtctgccaggtatgagaagaacacgtaagaccgccaccacactcaccctccctcaaggccctgtgccataggggtggccacccgacctgcccccagaacttttggatactggaggcagttgcataggtctccctctctgggcaccaggactcagtccagcccaagactactctgggcagctcccatcccagtctggggccatttgcagactcaggaaaggatttctacagtgttctataaaagccaaaagagagagtgggtttgggaagagtgagggtggttggggagaggggaccgatgtgcctcattgtttagtggtgattacaaatatgcttttctggataaagtttggttgtttgctcttggtg

SEQ ID NO: 151738 - DNA, 2153 bp, Homo sapiens
  Payload ID: 9863
  Gene Symbol: MARVELD2
  Gene Name: MARVEL domain containing 2
  Uniprot ID: Q8N4S9
  ENST ID: ENST00000325631
  CDS Start-End: 75-1751
gcccgataccggtttcagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtatttttagtagagacgaggtttcaccatgttggtcaggctgggaaactactttttttaaaaaatagcaagtttactatttatttactgcctttttaatgctagcctctgtggtagagaagcaagcgcttcccaaatcagcttccaattggtttaaccagtatgcaacattaaagattttactcagacattttt

SEQ ID NO: 151739 - DNA, 4376 bp, Homo sapiens
  Payload ID: 9863
  Gene Symbol: MARVELD2
  Gene Name: MARVEL domain containing 2
  Uniprot ID: Q8N4S9
  ENST ID: ENST00000454295
  CDS Start-End: 60-1700
cagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtatttttagtagagacgaggtttcaccatgttggtcaggctgggaaactactttttttaaaaaatagcaagtttactatttatttactgcctttttaatgctagcctctgtggtagagaagcaagcgcttcccaaatcagcttccaattggtttaaccagtatgcaacattaaagattttactcagacatttttaaacgaattcaaatgttctaagggcctttactaagaatggaaaaaatcctgtgttcatctttcatctgtgaccaatttcatattcatctatctcatttaaatgtgtcatcattttagagatcgtatcctggcagtgtgatgggcaagtggaccatcaattctggtgctactttttccttttttactcaggcaggttcctaggatttttctgggacaaatttctcttcctagagaaattcctaggggatttctaaaggatttttctaagggaaaaagggtgacatctttcaaaggtgtcatttattcccttgaaaggtgtttgaatcccagatcaacattttcagacatcctgatcttgggcaaattgcttaatctctctgtgcctgtttcctcttctgtaaaatggggctaataatagttccttcctcatagagttgttaggattaaaggagttactaatatggtaggaactatattagtgtttgtgaagtctactgaagtgtttgtgaaatgaataaattataaagaatgagtctcaagaaaaggtccttaatgagcaagcccaacctacttaaccaaaagcccaagtgtctggtgcctttctggtttgtggtgttaactcatggccttagcctggtgcttcactgtggctctgtggcccctggggttccacatggcctccctgtctttcatcagtgtgactgtacatctctccatctccccatagtccagcctgccctggacacattgaattgtatgaatggtattgcttttttttttttttttttgtgagacagagtcttactctgttgcccagactggagtgcagtggtgcgatctcggctcactgcaagctccgcctcccaagttcacgtcattttcctgcctcagcctcccgagtagctgggactacaggcacctgccaccacgcccagctaatttttttgtatttttagtagagatggggtttcaccgtgttagccaggatgatctcgatctcctgacctcatgatccacccgcctcagcctcccaaagtgttgggattacaggcgtgagtcaccgcgcccagctggtattgcttttctattccctttggacatacatgctacagtcccacaatgtagcatttccttggaaactccctttttttttttttttgagatggagtttcgctcttgttgcccaggctggagtacagtggtatgatcttggctcactgcagcctctgcctcctgggttcaagcgattctcctgcctctgcctcccaagtagctgggattacaggcacccaccaccatgcccagctaattttttgtatttttagtagagacaggatttcactatgttggccaggttggtctcaagctcctgacctcagatgatctaccagcctcggccttctgaagtgctgggattcaggtgtgagccactgtgcccagcagggatgcttcatctttctaagaattatcttggctttggactttattcataaatgttttatttctgttagtatgaacaatagactgccttaacaaagtttttttttaaacaaaatcgttcttgttggattttattcagcagcatctatcatgtagataaattcccaggtgtagcattacagcttctgactaatatagctgccattcagacaattaatgttcaaagagttttctaaagtgataaaaccaaagaaaagcatgtggaaaagcagaagcttagaaagttgtggtcactgaatgcactccctggtttttatttgtcagtgaaatctttatgcattcattgttaatattttaattccatggctttgtaggctgtgctgtgtctgaaggggtaacacctagggaaacatgaggccccttatgggaccccccaaatggaacaacttcactttctcttttatgtattgagccctgtgttaacatttcacttaagaagagcaccagtgctttaaaaaaaaaaaaaggtaaaatattaccattttgatagactgtaaagagttagattcctgttgaagtgttaaggaaatttaactttgtgaaacttttaaaataaagtttataaatgtagctaatctttgaaaaaccaatgcagtaacactgatttgtaaatgttgtggtcaatccctaggtgcattaaagtttcagtcacctgccgtgtgtgtgtgtgcccttttatgtttgccttcctagcattcctgtgttcactgtgcatgttcttgaaaatattttcacttgtcagaaaataaactggaaagtcattgaaaacccgta

SEQ ID NO: 151740 - DNA, 1584 bp, Homo sapiens
  Payload ID: 9863
  Gene Symbol: MARVELD2
  Gene Name: MARVEL domain containing 2
  ENST ID: ENST00000413223
  CDS Start-End: 19-1347
caggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtattgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccacctcccaaagtgttgggattacaggcgtgagtcaccgcgcccagctggtattgcttttctattccctttggacat

SEQ ID NO: 151741 - DNA, 1563 bp, Homo sapiens
  Payload ID: 9863
  Gene Symbol: MARVELD2
  Gene Name: MARVEL domain containing 2
  ENST ID: ENST00000436532
  CDS Start-End: 19-1347
caggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtattgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtattttta

SEQ ID NO: 151742 - DNA, 576 bp, Homo sapiens
  Payload ID: 9863
  Gene Symbol: MARVELD2
  Gene Name: MARVEL domain containing 2
  ENST ID: ENST00000515844
  CDS Start-End: 141-576
cccaggtgtgctgcgacggacggctgcccgcgctcggcgctcagcctgccatagcccgcgggggaggccggagccagggatccggggaggcccgcgtcccgccaggtttcgctctgcggacgcaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagtt

SEQ ID NO: 151743 - DNA, 1908 bp, Homo sapiens
  Payload ID: 9863
  Gene Symbol: MARVELD2
  Gene Name: MARVEL domain containing 2
  ENST ID: ENST00000512803
  CDS Start-End: 359-1908
gcggggcggggcgcgcacctcggggcgatctcggtgctccttacctgggaggtctcccggcttagtttcggcctcgttgggtcggaatctccaaagacagtgggtttcagccagaaacgcgaagacgaacgcctagccggcgcgggcagaaccgaggacacaatgagatttgtgggaccgggcgcccagaggctggcgcgggggagaccccacagctaaaatgctcggtacccccgggcagtcgtgggttagttagaaccgcagagcctttcccgacccctcggaagcgcagaagtatccgaaatctacccgtttcttgggtccagcaaaacttttaagccaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaa

SEQ ID NO: 151744 - DNA, 1563 bp, Homo sapiens
  Payload ID: 9863
  Gene Symbol: MARVELD2
  Gene Name: MARVEL domain containing 2
  ENST ID: ENST00000611064
  CDS Start-End: 19-1347
caggtgtgaaaatcacaaatgtcaaatgatggaagatccaggaatcgggacaggcgctacgatgaggtcccaagcgacctgccctatcaagataccaccataagaacccacccaattcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtattgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtattttta

SEQ ID NO: 151745 - DNA, 4400 bp, Homo sapiens
  Payload ID: 9863
  Gene Symbol: MARVELD2
  Gene Name: MARVEL domain containing 2
  Uniprot ID: Q8N4S9
  ENST ID: ENST00000614617
  CDS Start-End: 60-1700
cagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaattcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtatttttagtagagacgaggtttcaccatgttggtcaggctgggaaactactttttttaaaaaatagcaagtttactatttatttactgcctttttaatgctagcctctgtggtagagaagcaagcgcttcccaaatcagcttccaattggtttaaccagtatgcaacattaaagattttactcagacatttttaaacgaattcaaatgttctaagggcctttactaagaatggaaaaaatcctgtgttcatctttcatctgtgaccaatttcatattcatctatctcatttaaatgtgtcatcattttagagatcgtatcctggcagtgtgatgggcaagtggaccatcaattctggtgctactttttccttttttactcaggcaggttcctaggatttttctgggacaaatttctcttcctagagaaattcctaggggatttctaaaggatttttctaagggaaaaagggtgacatctttcaaaggtgtcatttattcccttgaaaggtgtttgaatcccagatcaacattttcagacatcctgatcttgggcaaattgcttaatctctctgtgcctgtttcctcttctgtaaaatggggctaataatagttccttcctcatagagttgttaggattaaaggagttactaatatggtaggaactatattagtgtttgtgaagtctactgaagtgtttgtgaaatgaataaattataaagaatgagtctcaagaaaaggtccttaatgagcaagcccaacctacttaaccaaaagcccaagtgtctggtgcctttctggtttgtggtgttaactcatggccttagcctggtgcttcactgtggctctgtggcccctggggttccacatggcctccctgtctttcatcagtgtgactgtacatctctccatctccccatagtccagcctgccctggacacattgaattgtatgaatggtattgcttttttttttttttttttgtgagacagagtcttactctgttgcccagactggagtgcagtggtgcgatctcggctcactgcaagctccgcctcccaagttcacgtcattttcctgcctcagcctcccgagtagctgggactacaggcacctgccaccacgcccagctaatttttttgtatttttagtagagatggggtttcaccgtgttagccaggatgatctcgatctcctgacctcatgatccacccgcctcagcctcccaaagtgttgggattacaggcgtgagtcaccgcgcccagctggtattgcttttctattccctttggacatacatgctacagtcccacaatgtagcatttccttggaaactcccttttttttttttttttgagatggagtttcgctcttgttgcccaggctggagtacagtggtatgatcttggctcactgcagcctctgcctcctgggttcaagcgattctcctgcctctgcctcccaagtagctgggattacaggcacccaccaccatgcccagctaattttttgtatttttagtagagacaggatttcactatgttggccaggttggtctcaagctcctgacctcagatgatctaccagcctcggccttctgaagtgctgggattcaggtgtgagccactgtgcccagcagggatgcttcatctttctaagaattatcttggctttggactttattcataaatgttttatttctgttagtatgaacaatagactgccttaacaaagtttttttttaaacaaaatcgttcttgttggattttattcagcagcatctatcatgtagataaattcccaggtgtagcattacagcttctgactaatatagctgccattcagacaattaatgttcaaagagttttctaaagtgataaaaccaaagaaaagcatgtggaaaagcagaagcttagaaagttgtggtcactgaatgcactccctggtttttatttgtcagtgaaatctttatgcattcattgttaatattttaattccatggctttgtaggctgtgctgtgtctgaaggggtaacacctagggaaacatgaggccccttatgggaccccccaaatggaacaacttcactttctcttttatgtattgagccctgtgttaacatttcacttaagaagagcaccagtgctttaaaaaaaaaaaaaaaaaaaaaaaaaaaaaaaaaaaaggtaaaatattaccattttgatagactgtaaagagttagattcctgttgaagtgttaaggaaatttaactttgtgaaacttttaaaataaagtttataaatgtagctaatctttgaaaaaccaatgcagtaacactgatttgtaaatgttgtggtcaatccctaggtgcattaaagtttcagtcacctgccgtgtgtgtgtgtgcccttttatgtttgccttcctagcattcctgtgttcactgtgcatgttcttgaaaatattttcacttgtcagaaaataaactggaaagtcattgaaaacccgta

SEQ ID NO: 151746 - DNA, 2153 bp, Homo sapiens
  Payload ID: 9863
  Gene Symbol: MARVELD2
  Gene Name: MARVEL domain containing 2
  Uniprot ID: Q8N4S9
  ENST ID: ENST00000622835
  CDS Start-End: 75-1751
gcccgataccggtttcagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaattcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtatttttagtagagacgaggtttcaccatgttggtcaggctgggaaactactttttttaaaaaatagcaagtttactatttatttactgcctttttaatgctagcctctgtggtagagaagcaagcgcttcccaaatcagcttccaattggtttaaccagtatgcaacattaaagattttactcagacattttt

SEQ ID NO: 151747 - DNA, 576 bp, Homo sapiens
  Payload ID: 9863
  Gene Symbol: MARVELD2
  Gene Name: MARVEL domain containing 2
  ENST ID: ENST00000611349
  CDS Start-End: 141-576
cccaggtgtgctgcgacggacggctgcccgcgctcggcgctcagcctgccatagcccgcgggggaggccggagccagggatccggggaggcccgcgtcccgccaggtttcgctctgcggacgcaggtgtgaaaatcacaaatgtcaaatgatggaagatccaggaatcgggacaggcgctacgatgaggtcccaagcgacctgccctatcaagataccaccataagaacccacccaattcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagtt

SEQ ID NO: 151748 - DNA, 1908 bp, Homo sapiens
  Payload ID: 9863
  Gene Symbol: MARVELD2
  Gene Name: MARVEL domain containing 2
  ENST ID: ENST00000622563
  CDS Start-End: 359-1908
gcggggcggggcgcgcacctcggggcgatctcggtgctccttacctgggaggtctcccggcttagtttcggcctcgttgggtcggaatctccaaagacagtgggtttcagccagaaacgcgaagacgaacgcctagccggcgcgggcagaaccgaggacacaatgagatttgtgggaccgggcgcccagaggctggcgcgggggagaccccacagctaaaatgctcggtacccccgggcagtcgtgggttagttagaaccgcagagcctttcccgacccctcggaagcgcagaagtatccgaaatctacccgtttcttgggtccagcaaaacttttaagccaggtgtgaaaatcacaaatgtcaaatgatggaagatccaggaatcgggacaggcgctacgatgaggtcccaagcgacctgccctatcaagataccaccataagaacccacccaattcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaa

SEQ ID NO: 151749 - DNA, 1584 bp, Homo sapiens
  Payload ID: 9863
  Gene Symbol: MARVELD2
  Gene Name: MARVEL domain containing 2
  ENST ID: ENST00000612528
  CDS Start-End: 19-1347
caggtgtgaaaatcacaaatgtcaaatgatggaagatccaggaatcgggacaggcgctacgatgaggtcccaagcgacctgccctatcaagataccaccataagaacccacccaattcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtattgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccacctcccaaagtgttgggattacaggcgtgagtcaccgcgcccagctggtattgcttttctattccctttggacat

SEQ ID NO: 151750 - DNA, 2912 bp, Homo sapiens
  Payload ID: 9864
  Gene Symbol: MARVELD3
  Gene Name: MARVEL domain containing 3
  Uniprot ID: Q96A59
  ENST ID: ENST00000268485
  CDS Start-End: 45-1250
tgttgccctcaggtcgctcccgggcggggacacggaacccggccatggaagatccgtcgggggctcgcgagccccgggcccggccgagagagcgggacccgggacggcgcccccacccagaccaaggccgcacccacgatcgaccgcgggaccgacccggggacccgcgcaggaagcgaagcagcgacgggaaccggcgaagggacggggaccgggacccggagagagaccaggagagggacgggaaccgcgaccggaaccgggaccgggagagggagagagagagggaaagagacccggaccgaggcccccgccgggacacacacagggacgcgggccctcgcgcaggtgaacacggagtttgggaaaaaccgcgccaaagccggacgcgggacggagcccggggactgacctgggacgcagccgcgcctcctgggcccgcgccctgggaagccccggagccgccgcagccgcagaggaagggagaccccgggcgccgcagacccgaaagtgaacccccttcggagagatatctgccctcgacccccaggcctggacgagaggaggtggaatattaccagtcagaggcggaaggactcctggaatgccacaaatgcaaatacttgtgcactgggagagcctgctgccaaatgctggaggttctcctgaacttgctgatcctggcctgcagctctgtgtcttacagttccacagggggctacacgggcatcaccagcttggggggcatttactactatcagttcggaggggcttacagtggctttgatggtgctgacggggagaaggcccagcaactggatgtccagttctaccagctaaagctgcccatggtcactgtggcaatggcctgtagtggagccctcacagccctctgctgcctcttcgttgccatgggtgtcctgcgggtcccgtggcattgtccactgttgctggtgaccgaaggcttgttggacatgctcatcgcgggggggtacatcccggccttgtacttctacttccactacctctctgctgcctatggctctcctgtgtgtaaagagaggcaggcgctgtaccaaagcaaaggctacagcggtttcggctgcagtttccacggagcagatataggagctggaatctttgctgccctgggcattgtggtctttgccctgggggctgtcctggccataaagggctaccgaaaagttaggaagctaaaagagaagccagcagaaatgtttgaattttaagggtttctaaaacgctctgacagatgcaagtggtggtggaaggtagtctgagccactgcctttcccaagaatcccttgttgtggaagtttccagtgctggaaaagcagcgagccagcgttggtgtggtgggcggagctcccagtcgcatggagcggtgttcatggatgcaacagaccctggcttctggagtcctctgtgagtgagggaccaatcaaaattatttttcaaaaagcaaaaaaatggccggcctcggcggctcacacctgtaaccccagcactttgggaggctgaggtgggtggatcacttgaggtcaggagctcgagaccagcttggccaacatggtgagcccccgtctctactaaaatacaaaaaaattagccaggcgtggtggcgggcgcctgtaatcccagctacttgggaggctgaggcaggagaatcgcttgaatctgggaggcggagattgcagtgagccgagatcccgccactgcactccagcccaggtgacagagcgagactccatctcaaaaaaaaaaaaaagcaaaaaaactggaccccaagagccacaaggaaaaagcatgtactacaacagagtgcacctcttcattcagtaaagggaggtcaccaagagaatttgatgaaccttaccttcaaagttcctgggcacagtggctcacacctgtaatcccagagctttgggaggctgaggtaggaggattgcttgaacccaggagttcaagtttgcagtgcgctatgattgtcccactacactctagcctgagcaacagaccaagaccgtattgccaaaataccaaaaaaaaaaaaagttcatggagagccacatagacatgagaccacacttcagcctgaatttttctaaaacacagttgtctcaagcagattactccacacgtttttccacactgaactctccagtccttccacttccttaattctgcaaatggagggggtggggactcttgggaaactactcctgtaaaattgaagttggaggtaggcgtgggctgaggaaagaggaatcagattaattctctgggttgcaaagaggctattctgcaagccccttacagtggccctgaaagctcaataagtgttttgtacctcttgtaaatgtgccattgtgtgaagcattaaacccaacatctagaattcaggattcatccagaataaaaggatgtaaaatctttcccaacagaagagtgttacttttggtcagacaacttcatgggttcttactgcacattaaattatgacttatggaacattgcaatatattctcggtccttaagttatgacttatggaacattacaatatattctcggtccaagtgagtaagttctttgctttatgtgaatccaataaaaaatccaaagaattttaatttggagttgatgtcctctttacaatacatttataatattctcttaaatacagacaatttttcacatttaaaaggtgagttccatttgagtttagaaaaggaaatatatatatacatgcttgtatatgattggaaaatttcttgaagaataacatcagaaagtattaagttttgcttttgaagagaaggggacttttcatttatacatggcttgactgcacatgtattaattttagaaaaataaaaagtaaaaaagttga

SEQ ID NO: 151751 - DNA, 2214 bp, Homo sapiens
  Payload ID: 9864
  Gene Symbol: MARVELD3
  Gene Name: MARVEL domain containing 3
  Uniprot ID: Q96A59
  ENST ID: ENST00000299952
  CDS Start-End: 44-1276
gttgccctcaggtcgctcccgggcggggacacggaacccggccatggaagatccgtcgggggctcgcgagccccgggcccggccgagagagcgggacccgggacggcgcccccacccagaccaaggccgcacccacgatcgaccgcgggaccgacccggggacccgcgcaggaagcgaagcagcgacgggaaccggcgaagggacggggaccgggacccggagagagaccaggagagggacgggaaccgcgaccggaaccgggaccgggagagggagagagagagggaaagagacccggaccgaggcccccgccgggacacacacagggacgcgggccctcgcgcaggtgaacacggagtttgggaaaaaccgcgccaaagccggacgcgggacggagcccggggactgacctgggacgcagccgcgcctcctgggcccgcgccctgggaagccccggagccgccgcagccgcagaggaagggagaccccgggcgccgcagacccgaaagtgaacccccttcggagagatatctgccctcgacccccaggcctggacgagaggaggtggaatattaccagtcagaggcggaaggactcctggaatgccacaaatgcaaatacttgtgcactgggagaggtgtggtgcagatagtggaggtggtcttgaatgggatggttctcatatgcatcgtggcctcctactttgtccttgccggattcagtgccagcttttccagcggcggtggctttgggaacaactactactcaccgttcgagggcactgagctagagcaggttcggcagctggaccagcagtacacgatcctccgctcgcccctgatatacggtggcgtggctgtttctctgggtctgggggtcctcaccatgggtgttttactccaaggagccaagagtcgaacaatgttgtcagggaagtggctcctcacggaggccgccttcagcctcctagcggcagtgggctactgcacaggcattggtgtttacctccacgtggctctgcagatcaatagcaccgacacttgcaaaacaagagagaggctctatgcccgcaagggtctcacctggatggactgccagctggcaggcaccgacggagcagcagccacctttgcttgtcttctcgtgatcatgtacggcgccagcgtggtgctggccctgcgtagctaccgagaacagaagcgctacaaaggcagccgagaacagcccggaagttacagtgatgcaccggaatatctgtggtctggaactctttgagatcttccggaacctaaatgtgaacgcacattgtttctctcaaaaagacaggtcttttaaaactccgcattagacaactatggttttcacacacttgactttataaatgctctctttggactgaggcaaagttaaagaattgaggacgggcatggtggctcatgcctgtaatcccagcactttgggaggctgaggtgggcggatcgcttgaggtcagcagattgagtccagcctggctcacatagcgaaaccctgtctctactaaaaatacaaaaaatcgccgggcatggtggctcacgcctgtaatcccagcactttaggaggccaaggcaggcagatcacctgaggtcaggtgtttgaaaccagtctggcaaacatggtgaaaccccatctctactaaaaatacaaaaattagctgggcgtggtggcaggcacctgtaattccagctactctggaggctgaggcaggagaatctcttaaacccgggaggcagaggttgcagtgagccaagaccattgcactccagcctgggcaacaagagcgagactccgtctcaaaaaaatacaaaaaatcatctgggcttggtggtgaacgcctgtaatcccagttactcaggaggctaaaccacaagaatcacttgaacctgggaggcagaggttgcagtgagcaaactccactccacgtcactgcactccagcctgggtaacagagcgaggctctgtctcaaaaacaacaactacaacaaaaaagataggacagtagattttattagaccctgaagcatactggaggctttttcatttctgcattccctgacagtgctccatagagtaggtcttcaaaggtagatagtaatctcattaccctggactgttctcataatgtaacagatcactaacactgaatcttaaaaataaagttcttttagtaattttaa

SEQ ID NO: 151752 - DNA, 582 bp, Homo sapiens
  Payload ID: 9864
  Gene Symbol: MARVELD3
  Gene Name: MARVEL domain containing 3
  ENST ID: ENST00000567501
  CDS Start-End: 193-375
aacttgcactcacaggaaggcagctcgcagctacctggtgagacagctcccaggggcagacaaaccatcagcggtaccaatcacagcatctgtcacgtgtgaacccccttcggagagatatctgccctcgacccccaggcctggacgagaggaggtggaatattaccagtcagaggcggaaggactcctggaatgccacaaatgcaaatacttgtgcactgggagagcctgctgccaaatgctggaggttctcctgaacttgctgatcctggcctgcagctctgtgtcttacagttccacagggggctacacgggcatcaccagcttggggggcatttactactatcagttcggaggggcttacagtggctttgatggtgctgacggggagaaggcccagcaactggatgtccagttctaccagctaaagctgcccatggtcactgtggcaatggcctgtagtggagccctcacagccctctgctgcctcttcgttgccatgggtgtcctgcgggtcccgtggcattgtccactgttgctggtgaccgaaggcttgttggacatgctcatcgcgggggggta

SEQ ID NO: 151753 - DNA, 1351 bp, Homo sapiens
  Payload ID: 9864
  Gene Symbol: MARVELD3
  Gene Name: MARVEL domain containing 3
  Uniprot ID: Q96A59
  ENST ID: ENST00000565261
  CDS Start-End: 47-493
gttgttgccctcaggtcgctcccgggcggggacacggaacccggccatggaagatccgtcgggggctcgcgagccccgggcccggccgagagagcgggacccgggacggcgcccccacccagaccaaggccgcacccacgatcgaccgcgggaccgacccggggacccgcgcaggaagcgaagcagcgacgggaaccggcgaagggacggggaccgggacccggagagagaccaggagagggacgggaaccgcgaccggaaccgggaccgggagagggagagagagagggaaagagacccggaccgaggcccccgccgggacacacacagggacgcgggccctcgcgcagtgaacccccttcggagagatatctgccctcgacccccaggcctggacgagaggaggtggaatattaccagtcagaggcggaaggactcctggaatgccacaaatgcaaatacttgtgcactgggagaggtgtggtgcagatagtggaggtggtcttgaatgggatggttctcatatgcatcgtggcctcctactttgtccttgccggattcagtgccagcttttccagcggcggtggctttgggaacaactactactcaccgttcgagggcactgagctagagcaggttcggcagctggaccagcagtacacgatcctccgctcgcccctgatatacggtggcgtggctgtttctctgggtctgggggtcctcaccatgggtgttttactccaaggagccaagagtcgaacaatgttgtcagggaagtggctcctcacggaggccgccttcagcctcctagcggcagtgggctactgcacaggcattggtgtttacctccacgtggctctgcagatcaatagcaccgacacttgcaaaacaagagagaggctctatgcccgcaagggtctcacctggatggactgccagctggcaggcaccgacggagcagcagccacctttgcttgtcttctcgtgatcatgtacggcgccagcgtggtgctggccctgcgtagctaccgagaacagaagcgctacaaaggcagccgagaacagcccggaagttacagtgatgcaccggaatatctgtggtctggaactctttgagatcttccggaacctaaatgtgaacgcacattgtttctctcaaaaagacaggtcttttaaaactccgcattagacaactatggttttcacacacttgactttataaatgctctctttggactgaggcaaagttaaagaattgaggacgggcatggtggctcatgcctgtaatcccagcactttgggaggctgaggtgggcggatcgcttgaggtcagcagattgagtccagcctg

SEQ ID NO: 151754 - DNA, 850 bp, Homo sapiens
  Payload ID: 9864
  Gene Symbol: MARVELD3
  Gene Name: MARVEL domain containing 3
  ENST ID: ENST00000567566
  CDS Start-End: 70-729
ccacctgcccaagaaacttgttggttgttgccctcaggtcgctcccgggcggggacacggaacccggccatggaagatccgtcgggggctcgcgagccccgggcccggccgagagagcgggacccgggacggcgcccccacccagaccaaggccgcacccacgatcgaccgcgggaccgacccggggacccgcgcaggaagcgaagcagcgacgggaaccggcgaagggacggggaccgggacccggagagagaccaggagagggacgggaaccgcgaccggaaccgggaccgggagagggagagagagagggaaagagacccggaccgaggcccccgccgggacacacacagggacgcgggccctcgcgcaggtgaacacggagtttgggaaaaaccgcgccaaagccggacgcgggacggagcccggggactgacctgggacgcagccgcgcctcctgggcccgcgccctgggaagccccggagccgccgcagccgcagaggaagggagaccccgggcgccgcagacccgaaagtgaacccccttcggagagatatctgccctcgacccccaggcctggacgagaggaggtggaatattaccagtcagaggcggaaggactcctggaatgccacaaatgcaaatacttgtgcactgggagaggtgagccgttttgcaggctgtttgatcatttactgtcactggtggttctggaagggatggtctgagctggtgaagcaaaaatttaagcagattcccttgtgggttcctagcattttcatttctgtacttgtgaggttcttgttttcttaaaaaaaaaaaaaaaaaaaaaggaggaacgtctcaaaa

SEQ ID NO: 151755 - DNA, 1260 bp, Homo sapiens
  Payload ID: 9865
  Gene Symbol: MAS1L
  Gene Name: MAS1 proto-oncogene like, G protein-coupled receptor
  Uniprot ID: P35410
  ENST ID: ENST00000377127
  CDS Start-End: 55-1191
atggaccactgctcctgactgtgatgttgtggcccactcaggtcccagcaccccatggtctgggggaaaatttgctggttcagccagagggctggatggacagtgtttgctgagtcacagatatctctctcatgtagcctttgtctccacagtggtgaccaggaggcacagaacccaaacctggtatctcagctctgtggcgtctttcttcaaaatgagacgaatgaaaccatacatatgcagatgagcatggcagtgggacagcaggccctgcccttgaatatcattgcccccaaggctgtgctggtctccctctgtggggtcttattgaatggcactgtcttctggctgctttgctgtggggccacgaatccctacatggtatacatcctccacctggtcgctgctgacgtgatctatctttgctgctcggcagtggggttcttacaggtgactctgctaacttatcatggagtcgtgttttttatccctgatttcctggccatattgtctcccttctcctttgaggtgtgtctctgtctcctggtggccatcagcacagagcggtgtgtgtgtgtcctcttccccatctggtacagatgccaccgcccaaaatacacatctaatgttgtctgcaccctcatctggggcctgcctttttgcatcaacatagtaaaatcacttttcctaacttactggaaacatgtaaaggcatgtgtcatatttctaaagctttctgggctcttccatgctatcctttcacttgtgatgtgtgtgtcgagtctgactctactcattagattcctgtgctgctcccagcagcaaaaggccaccagggtctatgcggtggtgcagatctcggcccccatgttcctactctgggccctacccctgagcgtggcacccctcataacagatttcaaaatgtttgtcaccacctcctatttaatttccttgttcctcattataaacagcagcgccaaccctatcatttatttctttgtggggagcctcagaaagaaaaggctgaaggaatctctcagagtgattctccaacgggcgttagcagataagccagaggtggggaggaacaaaaaggcagctggcatcgacccaatggagcaaccacactctactcagcatgtggagaaccttcttcccagggagcacagggtcgatgtggaaacataatttcccacatctgagctggggaattgtacacatagtaacccagcctgttctgcatcataaggctgctgc

SEQ ID NO: 151756 - DNA, 1137 bp, Homo sapiens
  Payload ID: 9865
  Gene Symbol: MAS1L
  Gene Name: MAS1 proto-oncogene like, G protein-coupled receptor
  Uniprot ID: P35410
  ENST ID: ENST00000383549
  CDS Start-End: 1-1137
atggtctgggggaaaatttgctggttcagccagagggctggatggacagtgtttgctgagtcacagatatctctctcatgtagcctttgtctccacagtggtgaccaggaggcacagaacccaaacctggtatctcagctctgtggcgtctttcttcaaaatgagacgaatgaaaccatacatatgcagatgagcatggcagtgggacagcaggccctgcccttgaatatcattgcccccaaggctgtgctggtctccctctgtggggtcttattgaatggcactgtcttctggctgctttgctgtggggccacgaatccctacatggtatacatcctccacctggtcgctgctgacgtgatctatctttgctgctcggcagtggggttcttacaggtgactctgctaacttatcatggagtcgtgttttttatccctgatttcctggccatattgtctcccttctcctttgaggtgtgtctctgtctcctggtggccatcagcacagagcggtgtgtgtgtgtcctcttccccatctggtacagatgccaccgcccaaaatacacatctaatgttgtctgcaccctcatctggggcctgcctttttgcatcaacatagtaaaatcacttttcctaacttactggaaacatgtaaaggcatgtgtcatatttctaaagctttctgggctcttccatgctatcctttcacttgtgatgtgtgtgtcgagtctgactctactcattagattcctgtgctgctcccagcagcaaaaggccaccagggtctatgcggtggtgcagatctcggcccccatgttcctactctgggccctacccctgagcgtggcacccctcataacagatttcaaaatgtttgtcaccacctcctatttaatttccttgttcctcattataaacagcagcgccaaccctatcatttatttctttgtggggagcctcagaaagaaaaggctgaaggaatctctcagagtgattctccaacgggcgttagcagataagccagaggtggggaggaacaaaaaggcagctggcatcgacccaatggagcaaccacactctactcagcatgtggagaaccttcttcccagggagcacagggtcgatgtggaaacataa

SEQ ID NO: 151757 - DNA, 1137 bp, Homo sapiens; identical to SEQ ID NO: 151756
  Payload ID: 9865
  Gene Symbol: MAS1L
  Gene Name: MAS1 proto-oncogene like, G protein-coupled receptor
  Uniprot ID: P35410
  ENST ID: ENST00000383643
  CDS Start-End: 1-1137

SEQ ID NO: 151758 - DNA, 1137 bp, Homo sapiens; identical to SEQ ID NO: 151756
  Payload ID: 9865
  Gene Symbol: MAS1L
  Gene Name: MAS1 proto-oncogene like, G protein-coupled receptor
  Uniprot ID: P35410
  ENST ID: ENST00000451019
  CDS Start-End: 1-1137

SEQ ID NO: 151759 - DNA, 1137 bp, Homo sapiens; identical to SEQ ID NO: 151756
  Payload ID: 9865
  Gene Symbol: MAS1L
  Gene Name: MAS1 proto-oncogene like, G protein-coupled receptor
  Uniprot ID: P35410
  ENST ID: ENST00000449044
  CDS Start-End: 1-1137

SEQ ID NO: 151760 - DNA, 1137 bp, Homo sapiens; identical to SEQ ID NO: 151756
  Payload ID: 9865
  Gene Symbol: MAS1L
  Gene Name: MAS1 proto-oncogene like, G protein-coupled receptor
  Uniprot ID: P35410
  ENST ID: ENST00000420035
  CDS Start-End: 1-1137

SEQ ID NO: 151761 - DNA, 1137 bp, Homo sapiens; identical to SEQ ID NO: 151756
  Payload ID: 9865
  Gene Symbol: MAS1L
  Gene Name: MAS1 proto-oncogene like, G protein-coupled receptor
  Uniprot ID: P35410
  ENST ID: ENST00000415802
  CDS Start-End: 1-1137

SEQ ID NO: 151762 - DNA, 1137 bp, Homo sapiens; identical to SEQ ID NO: 151756
  Payload ID: 9865
  Gene Symbol: MAS1L
  Gene Name: MAS1 proto-oncogene like, G protein-coupled receptor
  Uniprot ID: P35410
  ENST ID: ENST00000418003
  CDS Start-End: 1-1137

SEQ ID NO: 151763 - DNA, 9841 bp, Homo sapiens
  Payload ID: 9866
  Gene Symbol: MAS1
  Gene Name: MAS1 proto-oncogene, G protein-coupled receptor
  Uniprot ID: P04201
  ENST ID: ENST00000252660
  CDS Start-End: 267-1244
ggatccagaagggtcattcaatcagttctcagtcttatcaggtctaagttcctttcttatcaggtcctaaaggcctaatcttatcattgtgacaaagataactgtagagtctgttaaacttttttttaataacatgaagattatgatttatagctgaatttctcccttttattccaattcaacaattttcatggctttttgtgtttgttttgttctggacatatttacagaaaattacctgaagagttccaacctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagctttcttctggccattactacacaattgtcacattatcagtgacttttctgtttggctacaacacgggcctctatctgctgacggccattagtgtggagaggtgcctgtcagtcctttaccccatctggtaccgatgccatcgccccaagtaccagtcggcattggtctgtgcccttctgtgggctctttcttgcttggtgaccaccatggagtatgtcatgtgcatcgacagagaagaagagagtcactctcggaatgactgccgagcagtcatcatctttatagccatcctgagcttcctggtcttcacgcccctcatgctggtgtccagcaccatcttggtcgtgaagatccggaagaacacgtgggcttcccattcctccaagctttacatagtcatcatggtcaccatcattatattcctcatcttcgctatgcccatgagactcctttacctgctgtactatgagtattggtcgacctttgggaacctacaccacatttccctgctcttctccacaatcaacagtagcgccaaccctttcatttacttctttgtgggaagcagtaagaagaagagattcaaggagtccttaaaagttgttctgaccagggctttcaaagatgaaatgcaacctcggcgccagaaagacaattgtaatacggtcacagttgagactgtcgtctaagaactgtgagggaagttgtggataaaaatggtggaacacaggtcatttttagtttgtgcttggaatatgacttaagtatctcctaaatgtgatacagaagaacatctcatcccatatgcatgagatactaattaatgatgaaattgaactcttgtactgtatcttctggaaatgacctgtcatttctgtacttgacaaagactctatttctttcagctcttttggcagcatcttaccatgaaccataaaaatgacttttgcaggaagatttacagatgtgtacgggacaaggtaacaaaactatttgttggaacttgaggaggcagcttgatgtagcaggaagaacaagggtcgcttcctgtgtgacctcaggcaagttgttaaacctctcagagcctcattttctcactcataaaatggttgcggcaatagtctatacctccttggtctgctgtgaagatgaaatgagaagatgaggcttgtaaagcacctggcacattgtggatgttcaacaaatatcagtctctcctcactcccttcaatggtagacaagatataaatttttgttttgtaaagcacacacacacacacacacacacacacacacacacagctctatcatgtacagaagttattatgtgtttttacatgttgaatgtaaatttacgaaggtcttctttttgcttgcagcatgaaagcatttcatggcattacacctctattgaaaaacatcgcggatgttatgatctaacaagccatgtgctagtgcatcatttcaggttgtgaagaaatacatttggccaccagtagaggagtttctcatggctccccttccctctgtgggaatactagatgaaatgaaagtctgtgttttgaaatcctttgattgcataaacatttttacgaatggagttgaatttatgacttcctgggggtgactgggaccttcctcccccatgaagaggtgggttatttgtagccagagttctcacctgcagccaagtgcgggtctctgcacctgtctgcctcctctcctcctgaggctttttttttttttttcatcacacctggaaggaggctcagtggcaagggctaatgaaaatgtggtcacatcctggaggactctgatatttttgctcatgacagatccttgcatgacttcctcagaatctttactcagcactccagggggggctctgcctcttgcctgccatgagttgccctccagacactgcacgtcctgggttttagctgtgaagcccgtcgcatagctatgtttatttccttctgtcccttctaggagttccacaaaagggcaatatgtcacatgattctacaggttgtaaaatgttcaagtccatagaaatgagcccgatagtatttattttaaccatttgctctttaaaaggtcagagaggcagtgatgtaattgttctctgttgctgcttgtccttccccatcctcttcctttctcaaaagaaatgatgtggggcagcttcgctgggggagaggagtctgtcccctcgagcaaggaccccactgccagccaagcttggatgcaggaggcttttcagtgggtgacaacatctgattcagaaacaaggcagctttgctttcaggagcccagatggggtgtggagcaatgacatttagaatgatcttgtttttggttgaaaacagagcattttccctgggaaagaacagaatatggagatcagagcaactcccctctgtttcctgtcctctcctgtgtgtgctgtgtgctggcctctggggtagggaaagggggccaacctcgtctcatctctaaggggatcttagtctcaaagaggaccctaaagactatcagatacaaggaatttctacctaaggaaaatatggtgaactaataggaagcccctatttattgtttttctgcagataaagtggggaaatcgaatgtgataatgaatataaaaattattctaaccttttaaaatgatgccttaccaagaggtaggaggtaggattcagagtttggcagggttataaagactaatttctttctgtcttcccccaaacccattcccaaagtgaactgtaaggttaaaactataacaagaagatttaagtaaatttgcaaatatgtagagaatactaaatcatttgtatcctttaggcattcagacaatttgcctaagtcattgtaggttactaggtgccacttccgagaattccttggggatggggaggagattgtttggataatgcctgtcctaactgaacgggaagggtttgtagcattcctactacaaagattcatgcacagccttctctgcagaacaccatgatgtggacaaggcaaagacggggaagcggaagccgctgtctatgtcataggagaaagagacaccgcataactacaacaccaggctgcacacaagtttgtttgacaagtgttaggaacaaaattgtgtggcagaggtcaccacagcaggggctcttcctgccacccccatattgcatgcagcctcttctgttccctcccctgcccactggggtttctcctcagcactcatcatgccatatatcgatttgcttatttgctcgttctctgtctcttcacgctagactataagctccttgagggcagggacgtagctttgctcactgctgtagccccagcttatttgctgtgttggtcgaatccactgcacccctctctgggctgtttcctttgtacatataaatagactcaaattgcttccacctaaccagaagccattccttgccccacagccctttccagtttctatctcccctccctcccttccttccaaaccaccttctggaaaggctcttccacactcactgtcctgactcttgccacaattcacccctcaacatcctgccatttgtcttgcagcctgaccatcatagagagattggtccagataggaaggtgagtaacttccacagtgtcaaatctgatgggctgttttctacctatgccttttgtggcatttaatacccacagtcttcctgaaattatctcttttcttggattctagtttgctacatttttctccagctctctttttgaatcctatcttcctgattggaatcttctcacttctttcctccctcttctactgctcctcccttaaatggacacattttccataattcagtggctgggcctctgctctcctctttctgagaaatctccctggatcctgatccataatcacctgcttattaatgaacctcaaatagacatttgctgaccagaaccctttgctgggctccagtcctgtgtgtccaatcatctaatggactttttgacccaatgtcctgcaggtgcttgtaacccattcatttccccaccgtttcttttttcttttcttttcttttccttttttttttttttttttttttttgagacagagtcttgctctgttgccccagctggagtgcggtggcgtgatttcggctcactgcaacctccacctcccaggttcaagcaattctcctgcctcagcctcccaagtagctgggattacaggagtgagccactgcgccgggcctgcccctattcttttttcagtgaagtacaccgctggtcaccctgtcccccttgctatgctattccctttgcacagactgctctacctttttttaatctagcaaactccatttatccatctacgtccagctcaagcattagagactcaggagagcctctggaagctgagttcctggataaccgtgccataccttttctttcccagactttccacatctttcccttcctcactctcagcaaatgatggctggctcccctttacacaaggggaatagaagcaaccggaagaactcttccagacatccccgctgtcccctctgctgacctagctccatcttcttcatatcagcctctcccctgtgtgctcagggggaactcactatgcccctccctggctaaggtgataccctggctaagatgctccaaccccttcccctgttgcctgcccgatggcatttcgccagcaattctccctctctgtcctgcaccatcaatttcagtccaggataacggaggacagaattttcaggaatcaggatggaggagggttggtgaacagcaccactggccttgactagcctgctccctgccacacatactggttgtttctctggagacagcattgtatgcactgagatgagcaactggagagccaccagcagccatcccctctctttgtgcctcacagctccagtgactgatggagatggagatgggatcgttggctgccttcatggagttgtttaaggagcacttagaagatgctttacgggcatccctagaatttcaccattagaagagtagttctgttaggttgaaatttgtctttttactcaacctcttcttaaattaggaatcacttctggaaaggaaaacacatcaagccatacatactttttcctgtgctttttctcatggagaggagcagcacaagacaagacacccagctgttcaggctgctgaatgagatggtgaggagtgggtggtagaagtgaagaaaggaggaggtgggagcaatcaagtatttgcttgcttgattccacaaacaagaagcttcttttctctttaacctaacatttgactgtttaactttgcaaggttatatgggaaaaaaaatccttgatatgaaaacattagcaaatgtatcacttataaaatgggtaccatcaggcctccccctgcttagcaccagagtctctctcactgcctcatctacagttttgtggatcagtcttgtgatgcctgagagtcaatgtgcaaactgtcctcgaactttaattgatgatcttgacaaacattcaggattctgtgaaggaggtaagagaggtgtcacagaactgctaaaatacacttcaactattgataaaagagcatggagcagagttagaccggttagcagctgaatcagaggtaaataaacaaggatgatgatgagatgggagcttccaaaaagaagcgttttaatatcaaatgttgaagagaggctcttgggaaaactgctgaagtctttagatatttttgcaaaaattacccactttttgatgttcagcaaaagtaaccattaagtaaagacagaaaaattggctgggtacggtggctcatgcctgtaatcccagcactttgggaggctgaggtgagcagatcacctgaggtcaggagtttgagaccagcctggccaacatggtgaaaccccatctctgctgaaaatacaaaaattagctgggtgtggtggtgggcacctgtaatcccagctacttgggaggctgaggcaggagaattgcttgaacctgggaggcggaggttgcagtaagctgagatcgcaccactgctctccagcctgggtgatagagtgagactccgtctcaaaaaaaagaaaaattatgccaaaaaattaagtacttttgtggcttaaaagaacaatgtattgtcatttctcaaggctccatgggttgattgagttcagtttctcatttggcgtctcttgtagttgtagtgagttgttggctgaggcagaagccacctgaaggcttgactaggcagggcaatcgaggtggtacactcacaaggctggtcatttcctggggctcagctggaaaggtggaccagagttcctacacaaggccctttgatgtggtttgggtttcttacaacatggtgattgtgttctggaaggaagtctcctgagacttagcttttcctaaaggccaaaaatcagctattggggtctcatttgcttaaaattattggcatgttgttgaaattataatgagttttagtaaagcaaaattaaaacaattttcatgattttaatttcacttttttcatgattttctatgaaattttggtcctcattttaacaagattcctttttaacaatcttttactaaaaccagtcattcatggataaggagatcctcttacactaattatttaaatgtgtacatatacatgttaatacaaagggttgaattgttaaagcaaattcagagtgacttacagatcttacccaacatgaaactaatgattcaaatgataagaggcaagtgccaggcacaaatgaaacactcttttctggaggagaccaacagttttaattatttctggggtttttttggtcaaatttctcatgttgcttctagattgttttccaaatgtcatttagttttctatctgtactttttgtgattctctgaattctctgtcagacatttcggagatcttcaattcttctgggtccattgctacagctttgttatctcttttgatgttgtcgttttcccctgagttttcacagtccttgcacttcacgtcgatccccgtgcaattgagaagatagtcacctctgacagttttttaagggttcttggtggtgtcagagctttgctacttagtattggaacttaaactctggtctgttgtttcttcctgttctgagtgagacttgcggtgagcactggaacttaaacattgccctggaactatattgctgctctgtcaacatttcccagttcagggaagatgtaagtgggtatcagaacttaatcttgagctttttgttgtttccaggccaggggagggctctcgagtatacctaggctcgtggaaaatgcagccagggatttggacctccctgtggattgtgccagccagtcccttcaccatggtgtccccactgatcagagctcagagtgcaccagtacaccagttgctgcaatcagtgcttggctttttgtccccagttcaccccaggtcattcagctatcctggcattcccagtggttcctgtgggacggggccagagtgggtgtcccatgaagatgaccagatcagtggggagataaaatgctcacctgtaattctctcctgtcaccttggaaaccatggatctagagacattctctgagtgacactatgccagctgggagtggtggcacagtccgaattgattgtttctcttaccagttctggcttctttcaattctgtggacctagggggtttctcagcttctccccaaagttctggtgaattcagggtggtgttcttgtctttgaatagttggaatctatttctgtggggggaatggttccagagaatcttctattctgccatcttgttgagctctcccaaaatgtccccttctcctacattggcacacgctttggtttcacattgactgatgagttttgagcaacgtatacaaagaaacattgttctcaaaggaaactggtgaagtttgggggtgcctccattttgcacgttgttcattacacaagtagaatatacttatgtgactacccgtaccctttctccagcctccctgccccataaacctataaatcccaaatttatttataatagacaatcttgacagattaggtatatcctgctggaaataggactagttcactgagtataacgtttctacagagcagtctgattgaggtcttcagcatctttgcaaggtgccctggttgaggttattgttccgcaggcactcctgtggggaaggagtgatttgcaggcttcatgctgacattacctgtatggtacattttggccaacaccagcctgttaatgcctgaggcagaggcctctggaatgagaaaacaggactggaagcctgcctacttagtagcttggcaagtgtcaacaagttaatctctgtgactggtgacttagttggagttccacccaaagcagatcctgagacaaggatttagtgcaagtaattcatgtggccatcatccagaggagcatgggagaaagtggggaatttagacagggaaaggaggaagttagcaaagggtgagtgaaggagaacaagggcccaggacagtgaggccccacctcagaactgccctcctggaagggcgaaggagccgtggcgccgacccccacctcctgcccctcaatagggagcatcactccccgacgtcaactcccagctcttcctggcctgccctgtgctcaggccgagcatggcctaaagcagggaatatgtctaggcagagtgacacagggagccatgggcaggtacaggatctacctgcaagtgactacaggggtggcttcagggctgaccaatggcatctgctatcatggaattaaagtaacctaccccacgaagtagctgtgccaagtaagtgaaataatgcacaaggaaattctgtgtaaactttcaagcatcaagcaaatgttagttatttcttgaggacgttatgtaaagtgatataagccaggcccggaaggacaaagactgtatgattccactcatatgaggggcttagagttgtcagattcatagagacagaaggtagaatggtggtggccgggggctggagggaggagggagtggggagttagtgtttagtaggaactgaatttcagtttgaggagatgaaaatgttctggggatctattgcacaacaatggacatgtagctaaccccactgtactgtattcttaaaaatgtttcagatggtaaattttatgttatgtatattttaccacaataaagaagtgagttattgt

SEQ ID NO: 151764 - DNA, 966 bp, Homo sapiens
  Payload ID: 9867
  Gene Symbol: MRGPRD
  Gene Name: MAS-related GPR, member D
  Uniprot ID: Q8TDS7
  ENST ID: ENST00000309106
  CDS Start-End: 1-966
atgaaccagactttgaatagcagtgggaccgtggagtcagccctaaactattccagagggagcacagtgcacacggcctacctggtgctgagctccctggccatgttcacctgcctgtgcgggatggcaggcaacagcatggtgatctggctgctgggctttcgaatgcacaggaaccccttctgcatctatatcctcaacctggcggcagccgacctcctcttcctcttcagcatggcttccacgctcagcctggaaacccagcccctggtcaataccactgacaaggtccacgagctgatgaagagactgatgtactttgcctacacagtgggcctgagcctgctgacggccatcagcacccagcgctgtctctctgtcctcttccctatctggttcaagtgtcaccggcccaggcacctgtcagcctgggtgtgtggcctgctgtggacactctgtctcctgatgaacgggttgacctcttccttctgcagcaagttcttgaaattcaatgaagatcggtgcttcagggtggacatggtccaggccgccctcatcatgggggtcttaaccccagtgatgactctgtccagcctgaccctctttgtctgggtgcggaggagctcccagcagtggcggcggcagcccacacggctgttcgtggtggtcctggcctctgtcctggtgttcctcatctgttccctgcctctgagcatctactggtttgtgctctactggttgagcctgccgcccgagatgcaggtcctgtgcttcagcttgtcacgcctctcctcgtccgtaagcagcagcgccaaccccgtcatctacttcctggtgggcagccggaggagccacaggctgcccaccaggtccctggggactgtgctccaacaggcgcttcgcgaggagcccgagctggaaggtggggagacgcccaccgtgggcaccaatgagatgggggcttga

SEQ ID NO: 151765 - DNA, 1409 bp, Homo sapiens
  Payload ID: 9868
  Gene Symbol: MRGPRE
  Gene Name: MAS-related GPR, member E
  Uniprot ID: Q86SM8
  ENST ID: ENST00000389832
  CDS Start-End: 308-1246
aggttcagggtttctcttgctgtccacacctgggcgagagctgagcggaagagaaggggtcctcagagagacaccttcctgaccggccccattccagctggatgccatgtgactcggaggagctggtggacactgaacaggagccgcccagaggctctggggactggagccctcggccgcggccaggatagatccaaggcccagggtcagagcaggcagggctcggccagtcctctgccccaaacggggcatcaggagagagagcgagcagaacacactcctgcagcatcccctggccccccgccccatgatggagcccagagaagctggacagcacgtgggggccgccaacggcgcccaggaggatgtggccttcaacctcatcatcctgtccctcaccgaggggctcggcctcggtgggctgctggggaatggggcagtcctctggctgctcagctccaatgtctacagaaaccccttcgccatctacctcctggacgtggcctgcgcggatctcatcttccttggctgccacatggtggccatcgtccccgacttgctgcaaggccggctggacttcccgggcttcgtgcagaccagcctggcaacgctgcgcttcttctgctacatcgtgggcctgagtctcctggcggccgtcagcgtggagcagtgcctggccgccctcttcccagcctggtactcgtgccgccgcccacgccacctgaccacctgtgtgtgcgccctcacctgggccctctgcctgctgctgcacctgctgctcagcggcgcctgcacccagttcttcggggagcccagccgccacttgtgccggacgctgtggctggtggcagcggtgctgctggctctgctgtgttgcaccatgtgtggggccagccttatgctgctgctgcgggtggagcgaggcccccagcggcccccaccccggggcttccctgggctcatcctcctcaccgtcctcctcttcctcttctgcggcctgcccttcggcatctactggctgtcccggaacctgctctggtacatcccccactacttctaccacttcagcttcctcatggccgccgtgcactgcgcggccaagcccgtcgtctacttctgcctgggcagtgcccagggccgcaggctgcccctccggctggtcctccagcgagcgctgggagacgaggctgagctgggggccgtcagggagacctcccgccggggcctggtggacatagcagcctgagccctggggcccccgaccccagctgcagcccccgtgaggcaagagggtgacttggggaaggtggtggggtcagaggctggggccagccggacctggaggaggccttggtgggtgacccggtcatgtgctgtcaaagttgtgacccttggtctggagcatgagg

SEQ ID NO: 151766 - DNA, 2295 bp, Homo sapiens
  Payload ID: 9869
  Gene Symbol: MRGPRF
  Gene Name: MAS-related GPR, member F
  Uniprot ID: Q96AM1
  ENST ID: ENST00000309099
  CDS Start-End: 384-1415
gatgagttcccggtggggctctggggggggctcctgagcggggcattccttcctgaagcctcatccccgctcagccctgctcagcccctcctcctactcccctccccctccccctcctgccgggccaggaattgggtttggggcgggttctgcttccaaagccatctcttccagcaggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggcccccggcgcggcctgcaggcacatggacatcttcctgggcatcctcctgttcctgctctgctgcccgctcatggtgctgccctgcctggccctcatcctgcacgtggagtgccgggcccgacggcgccagcgctctgccaagctcaaccacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagcccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcctgagactccagcgcctggaggaggcaggggcaggaagcggcctccaagacccttcgccttgggacaggaatgggcacctgcttctgagtccatacaggagaagaaagatctgtttcctctcctcgggcctccttctccctgggctggggactccaggggtggctgggagactgggcagccaccagcaaacagaccctgtggcccctgcccggctcccccacccattctgctcccctagagacctcttgtacagaagttgcccccaggtggtggggcccctccttgccctaggctggttggtaaaagagaggaggtcaacacccagcctagccacctctgcctcttgggtcagccctccttgactgtgtcccagccagcaccaggccagcagcctcatccctgccattcagggctgttccagagattcgatcctcttaaggcattatcagtgagcaaatgtgaaggaaatggtgtctggaagaaagttctggttcacatgccttgtagctaagtctttctgcaaacaacctcccttccccccgtcgagtcatttggtgactttgatggggggatttctggttatgtcaaggctctggagacaggaagggcctttggccgccttgggtagttgacctgccttttctgactccgggacgagccagtcctaggctgcctccgggagcacttgaggtatcccgcaggccatgaggacccactgggcagctcctggacagcctcttggctccagcccccacccgaaagtggacactggctccgccctggccacctggggactggcactgtggtgcacagtggcccaatgtggccaacggaagttttataaaagacaaaatgtatatcaataaacattttataacttgca

SEQ ID NO: 151767 - DNA, 705 bp, Homo sapiens
  Payload ID: 9869
  Gene Symbol: MRGPRF
  Gene Name: MAS-related GPR, member F
  ENST ID: ENST00000320913
  CDS Start-End: 221-535
atctcttccagcaggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaaggtaagtgccacaggcggagggccctggtcttgcccagacgggtgtgggtgggaggggcagacccagcccagcatctcctcccccatcccccccttcctggccccactttccagctctggacccaccgtgggcagtgggctcctctgggctatgtggccgggcacaagttccctggaccctcctaccctcctgtcctcatcagtgaggcaagcaccaggactggacctcaaggtccctcgctgtgctgacactgtggtcgccttgtagcatccttgcaaggtcttgtttcatctcttccctgcagaggtggggcagtcagctacttactacagccaggcgggccaggaagccctgggacgctgactccaaggtggccctgatgtcatgtgctccatggagcctagggggtcctgggccaccccgagagtgttgcccca

SEQ ID NO: 151768 - DNA, 2282 bp, Homo sapiens
  Payload ID: 9869
  Gene Symbol: MRGPRF
  Gene Name: MAS-related GPR, member F
  Uniprot ID: Q96AM1
  ENST ID: ENST00000441623
  CDS Start-End: 368-1399
gggctcctgagcggggcattccttcctgaagcctcatccccgctcagccctgctcagcccctcctcctactcccctccccctccccctcctgccgggccaggaattgggtttggggcgggttctgcttccaaagccatctcttccagcaggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggcttctgccaggtgggtgtgcagactggtgagctgccagcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggcccccggcgcggcctgcaggcacatggacatcttcctgggcatcctcctgttcctgctctgctgcccgctcatggtgctgccctgcctggccctcatcctgcacgtggagtgccgggcccgacggcgccagcgctctgccaagctcaaccacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagcccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcctgagactccagcgcctggaggaggcaggggcaggaagcggcctccaagacccttcgccttgggacaggaatgggcacctgcttctgagtccatacaggagaagaaagatctgtttcctctcctcgggcctccttctccctgggctggggactccaggggtggctgggagactgggcagccaccagcaaacagaccctgtggcccctgcccggctcccccacccattctgctcccctagagacctcttgtacagaagttgcccccaggtggtggggcccctccttgccctaggctggttggtaaaagagaggaggtcaacacccagcctagccacctctgcctcttgggtcagccctccttgactgtgtcccagccagcaccaggccagcagcctcatccctgccattcagggctgttccagagattcgatcctcttaaggcattatcagtgagcaaatgtgaaggaaatggtgtctggaagaaagttctggttcacatgccttgtagctaagtctttctgcaaacaacctcccttccccccgtcgagtcatttggtgactttgatggggggatttctggttatgtcaaggctctggagacaggaagggcctttggccgccttgggtagttgacctgccttttctgactccgggacgagccagtcctaggctgcctccgggagcacttgaggtatcccgcaggccatgaggacccactgggcagctcctggacagcctcttggctccagcccccacccgaaagtggacactggctccgccctggccacctggggactggcactgtggtgcacagtggcccaatgtggccaacggaagttttataaaagacaaaatgtatatcaataaacattttataacttgcagcc

SEQ ID NO: 151769 - DNA, 870 bp, Homo sapiens
  Payload ID: 9870
  Gene Symbol: MRGPRG
  Gene Name: MAS-related GPR, member G
  Uniprot ID: Q86SM5
  ENST ID: ENST00000332314
  CDS Start-End: 1-870
atgtttgggctgttcggcctctggagaaccttcgacagtgtggtcttctacctgacgctgatcgtgggcctcgggggaccggtaggtaacgggctggtgctctggaacctcggcttccgcatcaagaagggccccttctccatctacctgctgcacctggccgccgccgacttcctgttcctctcctgccgtgtgggcttctccgtggctcaggctgccctgggcgcccaggacacactctacttcgtgctcaccttcctgtggttcgcggtggggctctggctgctggcggccttcagcgtggagcgctgcctctccgacctcttccccgcctgctaccagggctgccggcccagacacgcctcggccgtcctctgcgccctggtgtggaccccgaccctgccggccgtgccgctgcccgccaacgcctgcggcctgctgcgcaacagcgcgtgccccctggtctgcccgcgctaccacgtggccagcgtcacctggttcctggtgctggcccgcgtcgcctggacggctggcgtggtcctctttgtctgggtgacctgctgctccactcgcccgcggcccaggctctacggcatcgtcctgggcgcgctgctcctgctcttcttctgtggcctgccctcggtcttctactggagcctgcagcccctgctgaacttcctgctgcccgtgttttccccgctggccacgctgctggcctgcgtcaacagcagctccaagcccctcatctactcggggttgggccgacagcccgggaagcgggagccgctgaggtcggtactgcggagggccctgggggagggcgccgagctgggtgccaggggacagtccctgcccatgggtctcctataa

SEQ ID NO: 151770 - DNA, 1190 bp, Homo sapiens
  Payload ID: 9871
  Gene Symbol: MRGPRX1
  Gene Name: MAS-related GPR, member X1
  Uniprot ID: Q96LB2
  ENST ID: ENST00000302797
  CDS Start-End: 219-1187
aggtcaggcttcagagtcagcaagaactggatttcaaactggatttgaggacccccaccttttgataggtgacttattctctgtgagtctctgatctgccctctttaaatgaggaagtaaatcccacatggcagggtggtggggagaatcagagatcatacagctggtgatcacaactggtttctgtttccagggtcaccagactagggtttctgagcatggatccaaccatctcaaccttggacacagaactgacaccaatcaacggaactgaggagactctttgctacaagcagaccttgagcctcacggtgctgacgtgcatcgtttcccttgtcgggctgacaggaaacgcagttgtgctctggctcctgggctgccgcatgcgcaggaacgccttctccatctacatcctcaacttggccgcagcagacttcctcttcctcagcggccgccttatatattccctgttaagcttcatcagtatcccccataccatctctaaaatcctctatcctgtgatgatgttttcctactttgcaggcctgagctttctgagtgccgtgagcaccgagcgctgcctgtccgtcctgtggcccatctggtaccgctgccaccgccccacacacctgtcagcggtggtgtgtgtcctgctctgggccctgtccctgctgcggagcatcctggagtggatgttatgtggcttcctgttcagtggtgctgattctgcttggtgtcaaacatcagatttcatcacagtcgcgtggctgatttttttatgtgtggttctctgtgggtccagcctggtcctgctgatcaggattctctgtggatcccggaagataccgctgaccaggctgtacgtgaccatcctgctcacagtactggtcttcctcctctgtggcctgccctttggcattcagtttttcctatttttatggatccacgtggacagggaagtcttattttgtcatgttcatctagtttctattttcctgtccgctcttaacagcagtgccaaccccatcatttacttcttcgtgggctcctttaggcagcgtcaaaataggcagaacctgaagctggttctccagagggctctgcaggacgcgtctgaggtggatgaaggtggagggcagcttcctgaggaaatcctggagctgtcgggaagcagattggagcagtgagga

SEQ ID NO: 151771 - DNA, 2036 bp, Homo sapiens
  Payload ID: 9872
  Gene Symbol: MRGPRX2
  Gene Name: MAS-related GPR, member X2
  Uniprot ID: Q96LB1
  ENST ID: ENST00000329773
  CDS Start-End: 89-1081
gtttgccagtcccaggaaagcacttctcaactcaccaactccagtagaaagaagggtgttaaggggcaccagtggaggttttctgagcatggatccaaccaccccggcctggggaacagaaagtacaacagtgaatggaaatgaccaagcccttcttctgctttgtggcaaggagaccctgatcccggtcttcctgatccttttcattgccctggtcgggctggtaggaaacgggtttgtgctctggctcctgggcttccgcatgcgcaggaacgccttctctgtctacgtcctcagcctggccggggccgacttcctcttcctctgcttccagattataaattgcctggtgtacctcagtaacttcttctgttccatctccatcaatttccctagcttcttcaccactgtgatgacctgtgcctaccttgcaggcctgagcatgctgagcaccgtcagcaccgagcgctgcctgtccgtcctgtggcccatctggtatcgctgccgccgccccagacacctgtcagcggtcgtgtgtgtcctgctctgggccctgtccctactgctgagcatcttggaagggaagttctgtggcttcttatttagtgatggtgactctggttggtgtcagacatttgatttcatcactgcagcgtggctgatttttttattcatggttctctgtgggtccagtctggccctgctggtcaggatcctctgtggctccaggggtctgccactgaccaggctgtacctgaccatcctgctcacagtgctggtgttcctcctctgcggcctgccctttggcattcagtggttcctaatattatggatctggaaggattctgatgtcttattttgtcatattcatccagtttcagttgtcctgtcatctcttaacagcagtgccaaccccatcatttacttcttcgtgggctcttttaggaagcagtggcggctgcagcagccgatcctcaagctggctctccagagggctctgcaggacattgctgaggtggatcacagtgaaggatgcttccgtcagggcaccccggagatgtcgagaagcagtctggtgtagagatggacagcctctacttccatcagatatatgtggctttgagaggcaactttgcccctgtctgtctgatttgctgaactttctcagtcctgattttaaaacagttaagagagtccttgtgaggattaagtgagacagtgcctatgaaacaaacactaagtgcagtgtctctggaactgccttactcacaggcttccaccacagccctatgagagctttgccaactctgcggtccatgactgttcccacttttaatgaatcctacctttcgcagaaggctgaaagcagggcagaaaagatctacatttctttggacactgcacttgatagggactcaaagaatgttatatttttaattaatttctttttctcttccgtacaatttctgtctcaacaaaattagaagaattaaatttaaaactagctccaaaagagcagtcgtctttcattttggcagaccttagaatatccccctagcttaataaatctttgttgaatggcttaatgaatgaataaactggttaatgtttaagttaaacctctgaaaagtctccatttaccagatttgagtcactaaatttattgctttcactacttttgaattttgcaaacatgaaattaagttttataattagataaatcaatgtcaacacatatttaaagtttgaggtacactgtcttcctgtggtttcctttcacatgccatcccttaaaatcccagctacacgccttcccattccttcccctttgcctttgttctaatcttccctctctgggggctctctaattcgtcctggaagtttccagtggtcttatagactccatgttcttggaggacaggctgtatgtcagatttaccttttattccgaagaactcggagcatttattttgttaattaaattgcacatatttttaaaagttacgtgttccacagaataaaatactaattgtaaa

SEQ ID NO: 151772 - DNA, 1639 bp, Homo sapiens
  Payload ID: 9873
  Gene Symbol: MRGPRX3
  Gene Name: MAS-related GPR, member X3
  Uniprot ID: Q96LB0
  ENST ID: ENST00000396275
  CDS Start-End: 362-1330
gcccagtctggaaagtgaggagcgtctttgcccggccgccatcccatctaggaagtgaggagcgcctcttcccggccgccatcccatctaggaagtgaggagcgtctctgcccggccgcccatcgtctgagatgtggggagtgcctttgccccgccgccccgtctgggatgtgaggagcgcctctgcccggtcgcgaccccgtctgggagctcctgtaggcatctcctgaattaagcaacacagaaaagtcctctgaagtcactgaatcccataaaggctctctacctttagcacaagggaggtcttcaccactggacaaagaaggaacgataaggggtcatcagactggggtttctgagcatggattcaaccatcccagtcttgggtacagaactgacaccaatcaacggacgtgaggagactccttgctacaagcagaccctgagcttcacggggctgacgtgcatcgtttcccttgtcgcgctgacaggaaacgcggttgtgctctggctcctgggctgccgcatgcgcaggaacgctgtctccatctacatcctcaacctggtcgcggccgacttcctcttccttagcggccacattatatgttcgccgttacgcctcatcaatatccgccatcccatctccaaaatcctcagtcctgtgatgacctttccctactttataggcctaagcatgctgagcgccatcagcaccgagcgctgcctgtccatcctgtggcccatctggtaccactgccgccgccccagatacctgtcatcagtcatgtgtgtcctgctctgggccctgtccctgctgcggagtatcctggagtggatgttctgtgacttcctgtttagtggtgctaattctgtttggtgtgaaacgtcagatttcattacaatcgcgtggctggtttttttatgtgtggttctctgtgggtccagcctggtcctgctggtcaggattctctgtggatcccggaagatgccgctgaccaggctgtacgtgaccatcctcctcacagtgctggtcttcctcctctgtggcctgccctttggcattcagtgggccctgttttccaggatccacctggattggaaagtcttattttgtcatgtgcatctagtttccattttcctgtccgctcttaacagcagtgccaaccccatcatttacttcttcgtgggctcctttaggcagcgtcaaaataggcagaacctgaagctggttctccagagggctctgcaggacacgcctgaggtggatgaaggtggagggtggcttcctcaggaaaccctggagctgtcgggaagcagattggagcagtgaggaagaacctctgccctgtcagacaggactttgagagcaatgctgccctgccacccttgacaattatatgcatttttcttagccttctgcctcagaaatgtctcagtggtccctcaaggtcttcgaatagatgtttatctaacctgacagttgcagttttcacccatggaaagcattagtctgacagtacaatgtttggattctccttgatattaccaatacattttccctgttatcttgcactgaatctttcctactgaacactttttctgcacttttcattgtaataaaaggagttgctgtccacaa

SEQ ID NO: 151773 - DNA, 991 bp, Homo sapiens
  Payload ID: 9873
  Gene Symbol: MRGPRX3
  Gene Name: MAS-related GPR, member X3
  ENST ID: ENST00000531264
  CDS Start-End: 254-991
aaatacctctggcctctgatttgcccatagtcctcatacaggaaataacaagactgtccagcatcttcgtaagcctggattgctcaccagctttcatttcagctcctgtaggcatctcctgaattaagcaacacagaaaagtcctctgaagtcactgaatcccataaaggctctctacctttagcacaagggaggtcttcaccactggacaaagaaggaacgataaggggtcatcagactggggtttctgagcatggattcaaccatcccagtcttgggtacagaactgacaccaatcaacggacgtgaggagactccttgctacaagcagaccctgagcttcacggggctgacgtgcatcgtttcccttgtcgcgctgacaggaaacgcggttgtgctctggctcctgggctgccgcatgcgcaggaacgctgtctccatctacatcctcaacctggtcgcggccgacttcctcttccttagcggccacattatatgttcgccgttacgcctcatcaatatccgccatcccatctccaaaatcctcagtcctgtgatgacctttccctactttataggcctaagcatgctgagcgccatcagcaccgagcgctgcctgtccatcctgtggcccatctggtaccactgccgccgccccagatacctgtcatcagtcatgtgtgtcctgctctgggccctgtccctgctgcggagtatcctggagtggatgttctgtgacttcctgtttagtggtgctaattctgtttggtgtgaaacgtcagatttcattacaatcgcgtggctggtttttttatgtgtggttctctgtgggtccagcctggtcctgctggtcaggattctctgtggatcccggaagatgccgctgaccaggctgtacgtgaccatcctcctcacagtgctggtcttcctcctctgtggcctgccctttggcattcagtgggccctgttttccaggatccacctggattgg

SEQ ID NO: 151774 - DNA, 1429 bp, Homo sapiens
  Payload ID: 9873
  Gene Symbol: MRGPRX3
  Gene Name: MAS-related GPR, member X3
  Uniprot ID: Q96LB0
  ENST ID: ENST00000621697
  CDS Start-End: 154-1122
agctcctgtaggcatctcctgaattaagcaacacagaaaagtcctctgaagtcactgaatcccataaaggctctctacctttagcacaagggaggtcttcaccactggacaaagaaggaacgataaggggtcatcagactggggtttctgagcatggattcaaccatcccagtcttgggtacagaactgacaccaatcaacggacgtgaggagactccttgctacaagcagaccctgagcttcacggggctgacgtgcatcgtttcccttgtcgcgctgacaggaaacgcggttgtgctctggctcctgggctgccgcatgcgcaggaacgctgtctccatctacatcctcaacctggtcgcggccgacttcctcttccttagcggccacattatatgttcgccgttacgcctcatcaatatccgccatcccatctccaaaatcctcagtcctgtgatgacctttccctactttataggcctaagcatgctgagcgccatcagcaccgagcgctgcctgtccatcctgtggcccatctggtaccactgccgccgccccagatacctgtcatcagtcatgtgtgtcctgctctgggccctgtccctgctgcggagtatcctggagtggatgttctgtgacttcctgtttagtggtgctaattctgtttggtgtgaaacgtcagatttcattacaatcgcgtggctggtttttttatgtgtggttctctgtgggtccagcctggtcctgctggtcaggattctctgtggatcccggaagatgccgctgaccaggctgtacgtgaccatcctcctcacagtgctggtcttcctcctctgtggcctgccctttggcattcagtgggccctgttttccaggatccacctggattggaaagtcttattttgtcatgtgcatctagtttccattttcctgtccgctcttaacagcagtgccaaccccatcatttacttcttcgtgggctcctttaggcagcgtcaaaataggcagaacctgaagctggttctccagagggctctgcaggacacgcctgaggtggatgaaggtggagggtggcttcctcaggaaaccctggagctgtcgggaagcagattggagcagtgaggaagaacctctgccctgtcagacaggactttgagagcaatgctgccctgccacccttgacaattatatgcatttttcttagccttctgcctcagaaatgtctcagtggtccctcaaggtcttcgaatagatgtttatctaacctgacagttgcagttttcacccatggaaagcattagtctgacagtacaatgtttggattctccttgatattaccaatacattttccctgttatcttgcactgaatctttcctactgaacactttttctgcacttttcattgtaataaaaggagttgctgtccac

SEQ ID NO: 151775 - DNA, 1444 bp, Homo sapiens
  Payload ID: 9874
  Gene Symbol: MRGPRX4
  Gene Name: MAS-related GPR, member X4
  Uniprot ID: Q96LA9
  ENST ID: ENST00000314254
  CDS Start-End: 421-1389
cttcctgtccatggatgaccagtcctagtcacgagtgtgtcacaaccacctctttgtgtatctgaattcctccacctgaaagaaaatttcagacccaggatagattaatcatcgggtccaaagccctggccggatgagtgggggtgttttgatcctaatgttattcccatgtcagcacagaacttgtgtggcagtagagagatgtcaggcttcagagtcaacaagaactggatttcaaactggatttgaggacccccacctttggtaagtgacttattatctgcgagcctctgtttctctcttctttaaatgaggacagtaaatcccatacggcagggtggtggggagaatcagagatgatacagctggtgatcacatctggtttgtgttcccaggggcaccagactagggtttctgagcatggatccaaccgtcccagtcttcggtacaaaactgacaccaatcaacggacgtgaggagactccttgctacaatcagaccctgagcttcacggtgctgacgtgcatcatttcccttgtcggactgacaggaaacgcggttgtgctctggctcctgggctaccgcatgcgcaggaacgctgtctccatctacatcctcaacctggccgcagcagacttcctcttcctcagcttccagattatacgtttgccattacgcctcatcaatatcagccatctcatccgcaaaatcctcgtttctgtgatgacctttccctactttacaggcctgagtatgctgagcgccatcagcaccgagcgctgcctgtctgttctgtggcccatctggtaccgctgccgccgccccacacacctgtcagcggtcgtgtgtgtcctgctctggggcctgtccctgctgtttagtatgctggagtggaggttctgtgacttcctgtttagtggtgctgattctagttggtgtgaaacgtcagatttcatcccagtcgcgtggctgatttttttatgtgtggttctctgtgtttccagcctggtcctgctggtcaggatcctctgtggatcccggaagatgccgctgaccaggctgtacgtgaccatcctgctcacagtgctggtcttcctcctctgcggcctgcccttcggcattctgggggccctaatttacaggatgcacctgaatttggaagtcttatattgtcatgtttatctggtttgcatgtccctgtcctctctaaacagtagtgccaaccccatcatttacttcttcgtgggctcctttaggcagcgtcaaaataggcagaacctgaagctggttctccagagggctctgcaggacaagcctgaggtggataaaggtgaagggcagcttcctgaggaaagcctggagctgtcgggaagcagattggggccatgagggagagcctctgccctgtcagtcagacgggactttgagagcaacactgtcctgc

SEQ ID NO: 151776 - DNA, 969 bp, Homo sapiens
  Payload ID: 9874
  Gene Symbol: MRGPRX4
  Gene Name: MAS-related GPR, member X4
  ENST ID: ENST00000618161
  CDS Start-End: 1-969
atggatccaaccgtcccagtcttcggtacaaaactgacaccaatcaacggacgtgaggagactccttgctacaatcagaccctgagcttcacggtgctgacgtgcatcatttcccttgtcggactgacaggaaacgcggttgtgctctggctcctgggctaccgcatgcgcaggaacgctgtctccatctacatcctcaacctggccgcagcagacttcctcttcctcagcttccagattatacgtttgccattacgcctcatcaatatcagccatctcatccgcaaaatcctcgtttctgtgatgacctttccctactttacaggcctgagtatgctgagcgccatcagcaccgagcgctgcctgtctgttctgtggcccatctggtaccgctgccgccgccccacacacctgtcagcggtcgtgtgtgtcctgctctggggcctgtccctgctgtttagtatgctggagtggaggttctgtgacttcctgtttagtggtgctgattctagttggtgtgaaacgtcagatttcatcccagtcgcgtggctgatttttttatgtgtggttctctgtgtttccagcctggtcctgctggtcaggatcctctgtggatcccggaagatgccgctgaccaggctgtacgtgaccatcctgctcacagtgctggtcttcctcctctgcggcctgcccttcggcattctgggggccctaatttacaggatgcacctgaatttggaagtcttatattgtcatgtgcaaccagtttcagatgtcctgtcctctcttaacagcagtgccaaccccatcatttacttcttcatgggctcctttaggcagcgtcaaaattggcagaacctgaagctggttctccagaaggctctgcaggacacacctgaggtggatgaaggtggagggcggcttcctcaggaaaccctggagatgtcgggaagcagattggagcagtga

SEQ ID NO: 151777 - DNA, 631 bp, Homo sapiens
  Payload ID: 9875
  Gene Symbol: MILR1
  Gene Name: mast cell immunoglobulin-like receptor 1
  ENST ID: ENST00000605096
  CDS Start-End: 1-269
gaaaagctatgagaaataatgtgcccagggaccgtggagacacagccatggaagttggaatctatgcaaatatccttgaaaaacaagcaaaggaggaatctgtgccagaagtgggatccaggccgtgtgtttccacagcccaagatgaggccaaacactcccaggagctacagtatgccacccccgtgttccaggaggtggcaccaagagagcaagaagcctgtgattcttataaatctggatatgtctattctgaactcaacttctgaaatttacagaaacaaactacatctcaggatggagtctcactctgttgcccaggctggagttcagtagcgcgatcttggctcacttcaatctccatcttcccagttcaagcgattctcatgcctcgacctcccgagtagctgggattacaggtgcccgctaccacgcccagctaatttttgtatttttagtagagatggggtttcactatggtggccaggctggtcttgaactcctgacctcagatgatctgcctgcctcggcctcccaaagtgctggaactacaagcctgagccaccgtgcccggccctgaatcgctttagtaaataaagggtctccaagaataaattcatccgaacatgca

SEQ ID NO: 151778 - DNA, 762 bp, Homo sapiens
  Payload ID: 9875
  Gene Symbol: MILR1
  Gene Name: mast cell immunoglobulin-like receptor 1
  Uniprot ID: Q7Z6M3
  ENST ID: ENST00000612535
  CDS Start-End: 1-762
atgtggagccatttgaacaggctcctcttctggagcatattttcttctgtcacttgtagaaaagctgtattggattgtgaggcaatgaaaacaaatgacccggtgacttccccagtgctgaacattatggtcattcaaacagaaacagaccgacatataacattacattgcctctcagtcaatggctcgctgcccatcaattacactttctttgaaaaccatgttgccatatcaccagctatttccaagtatgacagggagcctgctgaatttaacttaaccaagaagaatcctggagaagaggaagagtataggtgtgaagctaaaaacagattgcctaactatgcaacatacagtcaccctgtcaccatgccctcaacaggcggagacagctgtcctttctgtctgaagctactacttccagggttattactgttgctggtggtgataatcctaattctggctttttgggtactgcccaaatacaaaacaagaaaagctatgagaaataatgtgcccagggaccgtggagacacagccatggaagttggaatctatgcaaatatccttgaaaaacaagcaaaggaggaatctgtgccagaagtgggatccaggccgtgtgtttccacagcccaagatgaggccaaacactcccaggagctacagtatgccacccccgtgttccaggaggtggcaccaagagagcaagaagcctgtgattcttataaatctggatatgtctattctgaactcaacttctga

SEQ ID NO: 151779 - DNA, 599 bp, Homo sapiens
  Payload ID: 9875
  Gene Symbol: MILR1
  Gene Name: mast cell immunoglobulin-like receptor 1
  ENST ID: ENST00000617071
  CDS Start-End: 40-599
ctatgccttctgaccccgtcttggacttcaactgggagaatgtggagccatttgaacaggctcctcttctggagcatattttcttctgtcacttgtagaaaagctgtattggattgtgaggcaatgaaaacaaatgaattcccttctccatgtttggactcaaagactaaggtggttatgaagggtcaaaatgtatctatgttttgttcccataagaacaaatcactgcagatcacctattcattgtttcgacgtaagacacacctgggaacccaggatggaaaaggtgaacctgcgatttttaacctaagcatcacagaagcccatgaatcaggcccctacaaatgcaaagcccaagttaccagctgttcaaaatacagtcgtgacttcagcttcacgattgtcgacccggtgacttccccagtgctgaacattatggtcattcaaacagaaacagaccgacatataacattacattgcctctcagtcaatggctcgctgcccatcaattacactttctttgaaaaccatgttgccatatcaccagctatttccaagtatgacagggagcctgctgaatttaacttaaccaagaagaa

SEQ ID NO: 151780 - DNA, 1196 bp, Homo sapiens
  Payload ID: 9875
  Gene Symbol: MILR1
  Gene Name: mast cell immunoglobulin-like receptor 1
  Uniprot ID: Q7Z6M3
  ENST ID: ENST00000615220
  CDS Start-End: 133-1164
agtattatgcaaacctcatccaaaccctctgatttccttaacttggctaagaaaaagaggaagttctccgagttactcaccactgtggttctactatgccttctgaccccgtcttggacttcaactgggagaatgtggagccatttgaacaggctcctcttctggagcatattttcttctgtcacttgtagaaaagctgtattggattgtgaggcaatgaaaacaaatgaattcccttctccatgtttggactcaaagactaaggtggttatgaagggtcaaaatgtatctatgttttgttcccataagaacaaatcactgcagatcacctattcattgtttcgacgtaagacacacctgggaacccaggatggaaaaggtgaacctgcgatttttaacctaagcatcacagaagcccatgaatcaggcccctacaaatgcaaagcccaagttaccagctgttcaaaatacagtcgtgacttcagcttcacgattgtcgacccggtgacttccccagtgctgaacattatggtcattcaaacagaaacagaccgacatataacattacattgcctctcagtcaatggctcgctgcccatcaattacactttctttgaaaaccatgttgccatatcaccagctatttccaagtatgacagggagcctgctgaatttaacttaaccaagaagaatcctggagaagaggaagagtataggtgtgaagctaaaaacagattgcctaactatgcaacatacagtcaccctgtcaccatgccctcaacaggcggagacagctgtcctttctgtctgaagctactacttccagggttattactgttgctggtggtgataatcctaattctggctttttgggtactgcccaaatacaaaacaagaaaagctatgagaaataatgtgcccagggaccgtggagacacagccatggaagttggaatctatgcaaatatccttgaaaaacaagcaaaggaggaatctgtgccagaagtgggatccaggccgtgtgtttccacagcccaagatgaggccaaacactcccaggagctacagtatgccacccccgtgttccaggaggtggcaccaagagagcaagaagcctgtgattcttataaatctggatatgtctattctgaactcaacttctgaaatttacagaaacaaactacatctcagggtaa

SEQ ID NO: 151781 - DNA, 747 bp, Homo sapiens
  Payload ID: 9875
  Gene Symbol: MILR1
  Gene Name: mast cell immunoglobulin-like receptor 1
  Uniprot ID: Q7Z6M3
  ENST ID: ENST00000616498
  CDS Start-End: 1-747
atgtggagccatttgaacaggctcctcttctggagcatattttcttctgtcacttgtagaaaagctgtattggattgtgaggcaatgaaaacaaatgaattcccttctccatgtttggactcaaagactaaggtggttatgaagggtcaaaatgtatctatgttttgttcccataagaacaaatcactgcagatcacctattcattgtttcgacgtaagacacacctgggaacccaggatggaaaaggtgaacctgcgatttttaacctaagcatcacagaagcccatgaatcaggcccctacaaatgcaaagcccaagttaccagctgttcaaaatacagtcgtgacttcagcttcacgattgtcggcggagacagctgtcctttctgtctgaagctactacttccagggttattactgttgctggtggtgataatcctaattctggctttttgggtactgcccaaatacaaaacaagaaaagctatgagaaataatgtgcccagggaccgtggagacacagccatggaagttggaatctatgcaaatatccttgaaaaacaagcaaaggaggaatctgtgccagaagtgggatccaggccgtgtgtttccacagcccaagatgaggccaaacactcccaggagctacagtatgccacccccgtgttccaggaggtggcaccaagagagcaagaagcctgtgattcttataaatctggatatgtctattctgaactcaacttctga

SEQ ID NO: 151782 - DNA, 1447 bp, Homo sapiens
  Payload ID: 9875
  Gene Symbol: MILR1
  Gene Name: mast cell immunoglobulin-like receptor 1
  Uniprot ID: Q7Z6M3
  ENST ID: ENST00000619286
  CDS Start-End: 55-1086
accactgtggttctactatgccttctgaccccgtcttggacttcaactgggagaatgtggagccatttgaacaggctcctcttctggagcatattttcttctgtcacttgtagaaaagctgtattggattgtgaggcaatgaaaacaaatgaattcccttctccatgtttggactcaaagactaaggtggttatgaagggtcaaaatgtatctatgttttgttcccataagaacaaatcactgcagatcacctattcattgtttcgacgtaagacacacctgggaacccaggatggaaaaggtgaacctgcgatttttaacctaagcatcacagaagcccatgaatcaggcccctacaaatgcaaagcccaagttaccagctgttcaaaatacagtcgtgacttcagcttcacgattgtcgacccggtgacttccccagtgctgaacattatggtcattcaaacagaaacagaccgacatataacattacattgcctctcagtcaatggctcgctgcccatcaattacactttctttgaaaaccatgttgccatatcaccagctatttccaagtatgacagggagcctgctgaatttaacttaaccaagaagaatcctggagaagaggaagagtataggtgtgaagctaaaaacagattgcctaactatgcaacatacagtcaccctgtcaccatgccctcaacaggcggagacagctgtcctttctgtctgaagctactacttccagggttattactgttgctggtggtgataatcctaattctggctttttgggtactgcccaaatacaaaacaagaaaagctatgagaaataatgtgcccagggaccgtggagacacagccatggaagttggaatctatgcaaatatccttgaaaaacaagcaaaggaggaatctgtgccagaagtgggatccaggccgtgtgtttccacagcccaagatgaggccaaacactcccaggagctacagtatgccacccccgtgttccaggaggtggcaccaagagagcaagaagcctgtgattcttataaatctggatatgtctattctgaactcaacttctgaaatttacagaaacaaactacatctcaggatggagtctcactctgttgcccaggctggagttcagtagcgcgatcttggctcacttcaatctccatcttcccagttcaagcgattctcatgcctcgacctcccgagtagctgggattacaggtgcccgctaccacgcccagctaatttttgtatttttagtagagatggggtttcactatggtggccaggctggtcttgaactcctgacctcagatgatctgcctgcctcggcctcccaaagtgctggaactacaagcctgagccaccgtgcccggccctgaatcgctttagtaaataaagggtctccaagaataaattcatccgaacatgc

SEQ ID NO: 151783 - DNA, 587 bp, Homo sapiens
  Payload ID: 9875
  Gene Symbol: MILR1
  Gene Name: mast cell immunoglobulin-like receptor 1
  ENST ID: ENST00000620304
  CDS Start-End: 1-269
gaaaagctatgagaaataatgtgcccagggaccgtggagacacagccatggaagttggaatctatgcaaatatccttgaaaaacaagcaaaggaggaatctgtgccagaagtgggatccaggccgtgtgtttccacagcccaagatgaggccaaacactcccaggagctacagtatgccacccccgtgttccaggaggtggcaccaagagagcaagaagcctgtgattcttataaatctggatatgtctattctgaactcaacttctgaaatttacagaaacaaactacatctcagggtaagatgctttttatgaagctgatttccatgaacaaaaagcaaacttgaggctgaggcaggtggattacttgaggtcaggagttcgagaccagcctggccaacatggcaaaaaccccatctctactaaaaatacaaaaattagccaggtgtggtggtgtgtgtgtgtagtcccagctactcgggaggctgaggcaggagaatcacttgagcccgggaggcagaggttgcagtgagccaagatcgtgccactgcactacagcctgggcgacaagagcaagacttcatctc

SEQ ID NO: 151784 - DNA, 1730 bp, Homo sapiens
  Payload ID: 9876
  Gene Symbol: MCEMP1
  Gene Name: mast cell-expressed membrane protein 1
  Uniprot ID: Q8IX19
  ENST ID: ENST00000333598
  CDS Start-End: 455-1018
ggggtggagctgaggggtggagctgaggctggagggaggaaggtgtggggggacccaggggtcctgtctccaagcctggttgctcttacgcgaaaagttgggacactgaggtgtcacagcttctcttttgaaatggagaggaggtaggagggtgaggtccatccaggtagacacagacacacacagagaccacagcttcctgtaacatttccgagtgtcgaattccatctcccggtctagaggtttttcttcttggtccttcctgagacctcttggctcccaagagcctcttgatcggggcaggaatgagggtgccccagggtgcgagagtcgtggatccctgaaaagaggaggctgctccccctctttcttccccccacctccagatttcctcatctgcccacaccttccggtgggcggggacgtgtatggacaaatttgcgggctggggaccatggaagtggaggaaatctacaagcaccaggaagtcaagatgcaagcaccagccttcagggacaagaaacagggggtctcagccaagaatcaaggtgcccatgacccagactatgagaatatcaccttggccttcaaaaatcaggaccatgcaaagggtggtcattcacgacccacgagccaagtcccagcccagtgcaggccgccctcagactccacccaggtcccctgctggttgtacagagccatcctgagcctgtacatcctcctggccctggcctttgtcctctgcatcatcctgtcagccttcatcatggtgaagaatgctgagatgtccaaggagctgctgggctttaaaagggagctttggaatgtctcaaactccgtacaagcatgcgaagagagacagaagagaggctgggattccgttcagcagagcatcaccatggtcaggagcaagattgatagattagagacgacattagcaggcataaaaaacattgacacaaaggtacagaaaatcttggaggtgctgcagaaaatgccacagtcctcacctcaataaatgagaggacattgtggcagccaaagccacaacttggaagatggggctgcacctgccaacgaagacgggaaatgaccccccccccccagcctagtgtgaacctgcccctcgtcccacgtatagaaaaacctcgagtcatggtgaatgagtgtctcggagttgctcgtgtgtgtgtacacctgcgtgcgtgtgtgtgcgtgtgtgcgcgtgtgttcgtgtatgtgcgtgtgtgcgtgcgcgtgtgtgtgcattttgcaaagggtggacatttcagtgtatctcccagaaaggtgatgaatgaataggactgagagtcacagtgaatgtggcatgcatgcctgtgtcatgtgacatatgtgagtctcggcatgtcacggtgggtggctgtgtctgagcacctccagcagatgtcactctgagtgtgggtgttggtgacatgcattgcacgggcctgtctccctgtttgtgtaaacatactagagtatactgcggcgtgttttctgtctacccatgtcatggtgggggagatttatctccgtacatgtgggtgtcgccatgtgtgccctgtcactatctgtggctgggtgaacggctgtgtcattatgagtgtgccgagttatgccaccctgtgtgctcagggcacatgcacacagacatttatctctgcactcacattttgtgacttatgaagataaataaagtcaagggaaaa

SEQ ID NO: 151785 - DNA, 763 bp, Homo sapiens
  Payload ID: 9876
  Gene Symbol: MCEMP1
  Gene Name: mast cell-expressed membrane protein 1
  ENST ID: ENST00000597445
  CDS Start-End: 34-468
gtggaggaaatctacaagcaccaggaagtcaagatgcaagcaccagccttcagggacaagaaacagggggtctcagccaagaatcaagtcccagcccagtgcaggccgccctcagactccacccaggtcccctgctggttgtacagagccatcctgagcctgtacatcctcctggccctggcctttgtcctctgcatcatcctgtcagccttcatcatggtgaagaatgctgagatgtccaaggagctgctgggctttaaaagggagctttggaatgtctcaaactccgtacaagcatgcgaagagagacagaagagaggctgggattccgttcagcagagcatcaccatggtcaggagcaagattgatagattagagacgacattagcaggcataaaaaacattgacacaaaggtacagaaaatcttggaggtgctgcagaaaatgccacagtcctcacctcaataaatgagaggacattgtggcagccaaagccacaacttggaagatggggctgcacctgccaacgaagacgggaaatgaccccccccccccagcctagtgtgaacctgcccctcgtcccacgtatagaaaaacctcgagtcatggtgaatgagtgtctcggagttgctcgtgtgtgtgtacacctgcgtgcgtgtgtgtgcgtgtgtgcgcgtgtgttcgtgtatgtgcgtgtgtgcgtgcgcgtgtgtgtgcattttgcaaagggtggacatttcagtgtatctcccagaaaggtgat

SEQ ID NO: 151786 - DNA, 4607 bp, Homo sapiens
  Payload ID: 9877
  Gene Symbol: MAMLD1
  Gene Name: mastermind-like domain containing 1
  Uniprot ID: Q13495
  ENST ID: ENST00000262858
  CDS Start-End: 64-2388
ccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaaagaagccctcgtggatggaggaagaagatttatcttttctctacaagagcagcccaggaagaaagcatcagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacagggctgttgccatctgtttgcatggacttctgcagctagctcggtgaagccccagcatcaacacgggaactctttcactagcaggcaagatcctcagcctggagacgtgtcaccgtctaacattactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagtcccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagccgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggagaaaagtgcc

SEQ ID NO: 151787 - DNA, 591 bp, Homo sapiens
  Payload ID: 9877
  Gene Symbol: MAMLD1
  Gene Name: mastermind-like domain containing 1
  ENST ID: ENST00000358892
  CDS Start-End: 183-591
aatcaagcctgggcaatggcgggcgcccctcccccagcctcgctgctgccttgcagtttgatctgactgctgtgctagcaatcagcgagactccgtgggcgtaggaccctccgagccagccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaaagaagccctcgtggatggaggaagaagatttatcttttctctacaagagcagcccaggaagaaagcatcagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatga

SEQ ID NO: 151788 - DNA, 4854 bp, Homo sapiens
  Payload ID: 9877
  Gene Symbol: MAMLD1
  Gene Name: mastermind-like domain containing 1
  Uniprot ID: Q13495
  ENST ID: ENST00000370401
  CDS Start-End: 311-2635
ggcgcggagccgggcggtgggaatggagcgagcagattgaggccgccactgcagcgccgccagcatgaacttggccgcgagctgaagcggccggcggcgggcgggcgcgggggcaccggccgctagccagggggtgatctgcaacagggctgggttccttggcggccgcctgagtccaggctgcccgcgccggcggccgcccgcccctcggacactgcccccgccgccgccggagctctgcagcacgccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaaagaagccctcgtggatggaggaagaagatttatcttttctctacaagagcagcccaggaagaaagcatcagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacagggctgttgccatctgtttgcatggacttctgcagctagctcggtgaagccccagcatcaacacgggaactctttcactagcaggcaagatcctcagcctggagacgtgtcaccgtctaacattactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagtcccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagccgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggagaaaagtgcc

SEQ ID NO: 151789 - DNA, 4532 bp, Homo sapiens
  Payload ID: 9877
  Gene Symbol: MAMLD1
  Gene Name: mastermind-like domain containing 1
  Uniprot ID: Q13495
  ENST ID: ENST00000426613
  CDS Start-End: 64-2313
ccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacagggctgttgccatctgtttgcatggacttctgcagctagctcggtgaagccccagcatcaacacgggaactctttcactagcaggcaagatcctcagcctggagacgtgtcaccgtctaacattactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagtcccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagccgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggagaaaagtgcc

SEQ ID NO: 151790 - DNA, 3224 bp, Homo sapiens
  Payload ID: 9877
  Gene Symbol: MAMLD1
  Gene Name: mastermind-like domain containing 1
  Uniprot ID: Q13495
  ENST ID: ENST00000432680
  CDS Start-End: 176-3172
gatctgcaacagggctgggttccttggcggccgcctgagtccaggctgcccgcgccggcggccgcccgcccctcggacactgcccccgccgccgccggagctctgcagcacgccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagtcccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagt

SEQ ID NO: 151791 - DNA, 5723 bp, Homo sapiens
  Payload ID: 9878
  Gene Symbol: MAML1
  Gene Name: mastermind-like transcriptional coactivator 1
  Uniprot ID: Q92585
  ENST ID: ENST00000292599
  CDS Start-End: 264-3314
cggccgcggcggtagcgcggaaaacaatggggccggggcggtggggagaggccgaggcttgaggtaggcagcaagcgccggctgggggtcgggccgagcggggcaggaggaaaacccgccgccgcgcgcgagcccgctccgctgccctcgggggcatggcgcggccgtgaggcggagaggggtagccgcggggagcgaagcccgcagtgccagccggccccgagaggcccggccccgggcccggcccgtgcagcccgcggcccatggtgctgcccacctgccccatggcggagttcgcgctgccgcggcacagcgcggtcatggagcgccttcgccggcgcatcgagctgtgccggcgccaccacagcacctgcgaggcccgctacgaggccgtgtcgcccgagcgcctggagctggagcgccaacacaccttcgccctgcaccagcgctgcatccaggccaaggccaagcgcgccgggaagcacaggcagccgcccgccgccacggccccggcgcccgccgccccggccccgcgcctggacgccgctgacggccccgagcacggccgcccggccacgcatcttcatgatacagttaagaggaatcttgacagcgccacttcccctcagaatggcgatcaacagaatggctacggggacctctttcctgggcataagaagactcgccgggaggcccctctgggagttgccatctcttccaatggactgcctccagcctcccccctcggtcagtctgacaagccttctggagccgacgccctgcagtccagtgggaagcactctctggggctagactctctcaacaaaaagcgtctggctgactccagccttcacttgaatggaggcagtaaccccagtgagtcatttcctctgagcctgaataaagaactgaagcaggagcctgtcgaagacctgccttgcatgatcactgggactgtcggctccatatcgcaaagcaacctcatgccagacctcaaccttaacgagcaggagtggaaggagctcatcgaggagctgaacaggtcggtgcccgatgaagacatgaaggacctgtttaatgaggacttcgaggagaagaaggacccagagtcttctggctctgccacacaaacccccttggcacaggacattaatattaagacggaattctctccagcagcctttgagcaagaacagttaggctctccacaagtgagggccgggtctgcagggcagacctttctggggccttcctctgcccctgtgagtacagattcccccagcctagggggctcccaaaccttattccacacctctggtcagccccgggcggacaatcccagtccaaacctgatgccggcatcagcccaggcccagaacgcacaaagagcccttgcaggtgtggtattgcccagtcagggcccaggaggggcctcagagctgtcctctgcccaccagctccagcagatcgctgccaagcagaagcgcgagcagatgctccagaacccacagcaggccaccccggcaccagccccgggccagatgtccacatggcagcagacggggccctcccacagttccttagatgtcccttaccccatggagaagcctgccagcccttccagctacaagcaagacttcactaactccaaactgctcatgatgcctagtgtgaataagagttcccctcggcccggaggcccctacctccagcccagccatgtgaacctgctgagtcaccagccaccgagtaacttgaatcagaactccgcgaataaccaggggtctgtgctggactacggcaatacaaaacccctttctcattacaaagcggactgtgggcaaggcagcccggggtctggccagagcaagccagccctgatggcttatcttccccagcagctgtcccatataagtcacgagcagaactccctgtttctgatgaagccaaagccaggaaatatgcctttccgatcactggttccacctggccaggagcagaacccttccagtgtccctgtgcaagcccaggctaccagtgttgggacccagccgcctgccgtgtccgtggccagctcccacaacagctccccctatctcagcagccagcaacaggccgctgtaatgaagcagcatcagttgcttttggaccaacagaaacaaagggagcagcagcaaaagcatttacagcaacagcagttccttcagaggcaacagcaccttctcgcggaacaggagaagcaacagtttcagcgccatctgacccgcccaccaccccagtaccaagacccgacacaaggcagcttcccacagcaggttggacagttcacagggtcctctgctgccgtgcccggcatgaacaccttgggtccatccaactccagctgtcctcgagtgttccctcaggctgggaatctgatgccaatgggccctggacatgcttcagtttcctctctccccacaaactcaggccaacaggaccggggtgtggctcagttccctggctcccaaaacatgcctcagagcagcctctatggcatggcttctggcataacccagatagttgcccagcccccgccacaggccaccaatggacatgcccacattccacggcagaccaacgtgggccagaacacctccgtctcagctgcctatgggcagaactctctgggaagctctggcctctcccagcagcacaataaggggaccctgaaccctggtttaacaaagccaccggtcccaagggtgtcaccagccatgggaggccagaattcctcctggcagcatcagggaatgccgaacctcagtggccagaccccagggaacagcaacgtgagtcccttcactgcagcctccagtttccacatgcagcagcaggcccacctgaaaatgtctagcccgcaattctcccaggcagtgcccaacaggcccatggctcccatgagctcagcagctgccgtggggtccttgctacccccagtgagtgcacagcagaggaccagcgcccctgccccagcaccacccccaacagcccctcagcagggcttgcctggcctgagcccagcagggcctgagctgggggccttcagccagagccctgcctcacagatgggcggtcgggcggggctgcactgcacccaggcctaccctgtgcggaccgcgggccaggagctgccttttgcctatagcgggcagccaggtggcagtgggctctctagtgtggctggacacaccgatctgatcgactccctgctgaagaacaggacttcagaggagtggatgagtgatttggacgacctgttagggtctcagtaatggaaggatttgtagtgtttttagtgttcattcatcctatatttttattctcagattcaaagaaagagcaactactttggaccaaaagcccatggcctggggagctgggcaggtagagcccaagctccaggtgaggcctggccctgggcagggtctgtggctgcgcccctcaggccagcagttgaggtccatcgggctggccccagcccatctgctggcatcagtacctggtgttgggacagcaggatagggttctaaaggtggttttctatccaaacgaccaaaaaaccaacagtaacaccagtgaaaccccacactgtcgggcttataaaaatctgtgccatcatggtgattttatccaagactgctccacttaccccagtgctggggacaagtttctgttgaaactttagatagcagaattatttgcaatttgtagcatagaaaagatttttaaatttttttacaaaaggtttttaaacagattagggtaggtgatggtttaaatcaattaagtggcattggaaacctagggtttccttttgattaagagccttttttgtttctgctctttgtcagctttcaggggagaaggaggccactggaaaattatttccctaagtgcaggctgttgactgcgtatgccaaaaagggacaggaggcatgggatagcaggtctggtgacacagctagggtcttcctagcagctcctcctcctccctcccaaggcccccaggaatcccttcctcccatgtcctggcagcaggaccccaggctacatatggaaggtagagatgtgggggtcctgtatcctggagtattatgtctccccaccttctgcagttttctctgaacatgtatgttgcccatggtgggagcgtggtcactgtgcagttgtgcacagatgtctttcctttaccgttggcctttctgtctgcctctccttcctctctgcagcccaaatggaaaacaattatttactccattggagggaaaggaagagtcttagaattcctaagggaaccttagcataaaggttttggggaaggaggccgtaggccggcccggaggaagcaattccacttggtttgacaacttctgccactcccatgtcagatgacttgcacttcttaaagagattgctttataacactaagacatcctttctaaagattcaagtggacttgactaagctgagggtccacgaaatagaatatgacatgtgagctgtttttggaaaacgaagatggagagagcacttccccgtaacgaaagcaaagtggtaagcacagggtgagacccttttacacagaatggtggagagaaaagagaatgctgaaaagtggctcagatgcagagtgttctgtggagaaactgcagccccacttctgtttccctggagtctcccaatggatcattcaggagtgtcctatgtgagaattgagccaaggaaaatactcatgcaaccagcctgagtcgcggtgaggggacgagaggttgtacacacattggtagttattttgcaccagcagtgcctttctcactgggggtacttggaccctcagatcttcttttctaatagccatttgccaccccaagtggtatgtcggccatttctccttaaaacaccttccctacctttcccatgtactcagtttagctctcaaagaaggggtgaatcataaagccagtgaaaatttcaccctctgagggagttccccaatctgaaggggaagagggtgacctcagcggcttttctcccaaaaatcggctgaaggctggttgtggatccttgttcctctcctgaccccatctggctgctgccccgtctcccacccctgtccccggggctcgctggccctgcactccgccttagtcctggggccggcgacacagtgggggctcctcacttgctgcagtgtcatagcaataaaatgtgattcttggggtccccccagggagctgcccatggctttatttatgaacctggttttcgggagtcaggggaggagatgactttgcttctgtgcacagccccgtcttccaggagccacaactcagaagaaaagggtgctcagacttttgttatacacatttgctttgtgtaaataaatgtttacaattttatatgaaagatggaataagcgctagagcttccaactgtatattttttacttttatagattttaaaactatgatcctttatatgtgtgttttgggggagctatgataagttttatggcaaacggttggtattgttaactttttattgtcatcaaaagttcataaaagtcctattaatccccatattcttctactgcccttaactctggtatacaccaaaaagaaatctttactttccttgttttatcattataaaaataaagtattttgctagtatggaaacaa

SEQ ID NO: 151792 - DNA, 7106 bp, Homo sapiens
  Payload ID: 9879
  Gene Symbol: MAML2
  Gene Name: mastermind-like transcriptional coactivator 2
  Uniprot ID: Q8IZL2
  ENST ID: ENST00000524717
  CDS Start-End: 1286-4756
ctccctctcctatcggagcacaatgaaagcctgtgtatcgccgtgactccgggcgcgagccagtgtcagcaaagcggctaacaacagacgagaaagagaaaggaaaatacaagctactttttttttccatctataaagcggagcaaatacaggagatagaaccagattgcttattgcgagtccagaccctcagatccactggccggggatggaatgtacaaaagtggacagaaaagtggctggacatgactcggtgcaatttgctggaagtttgtaagtttgaccatcgtttgtaaattactctcggaagagtttgtctctcttgatactgtattagaatagagccgggggtgaggaatagaaacgtaagcgggaaagaaaaaaatgtgttgaaggatctctctcagtggctagcgacttaagattgcttttcatttaaggctaggaaaccttagagggagtgaggattttaccggtgattggattagctgaagaaaaaagcatggtccaaaagtccaattactgacattgttaacagttgaaaagctgtctccctcttttgggagaagacaacatcctacagtaccccaaagaggagaaaacaccggagcgaaaggaaagggaggaaaaattaaaagccaaaagacagtctcccttgatttttgcacattttgaacagtgacttaaacatcttctgaaacagcactgttttgttttgttttggttttttatttaacctgaggaaaagtcaaggctgctggttacatagacatggtagaaatgtgtttctctgcagaaacatccccataaagaattgtcggaaacaactaggtgagggggagtcctctctattaatacctctctcaataccttttgctgtgtgtttctgtctcttgctggacaatccctgaattcttgatctaacccccagatcgtgtgtttacaaagtacctagtggctcttgtcagcttggtggaggaaaaaaaatccaccaactctgtccaacttctccagagctgtcaaatgcaattagagtaagttaatcagggtttgtttccaacttatcctccccccagttggtttctattctttctccccaccctctttttactaactcccctcccccacaacttctccacggctcccccacaacctctgaagacctctattcatgtggccctgaacactgagctcacattgtcaaaaacagacttgcctgcaatagccagcagtagcctctttccacctcaccatcccagaggcagcaatcattgtgtccggtaagatgggggacacagcgcccccgcaggcccccgcaggagggctagggggggcctctggggcggggctccttggagggggctcagtcaccccgagagtgcacagtgctatcgtggagcgcctccgggctcggatcgctgtctgccgccaacaccacctgagctgtgaaggacgatatgaacgaggtagggccgagagctcagaccgggaaagagaaagcaccttgcagctcctgagccttgtacagcatggccagggggcaaggaaagctggcaaacacaccaaggccaccgccactgctgccaccactacagcccctccaccgccccctgctgcccctcctgcggcctcccaagcagcagcaacagcagccccaccgcccccaccagactatcaccatcaccaccagcagcacctgctgaacagtagcaataatggtggcagtggtgggataaacggagagcagcagccgcccgcttcaaccccaggggaccagaggaactcagccctgattgcgctccagggttccttgaaaagaaaacaggtagttaacctatctcctgccaacagcaagcgacccaatggctttgtggacaactcatttcttgatatcaaaagaattcgtgttggggagaatctctctgcaggacaaggtggcctccaaataaacaatggacaaagtcagattatgtcagggaccttgcctatgagccaagcacccctgcgaaagactaacactctgccatcccatacacattctcctggcaatggcctgtttaacatgggcttaaaggaggtaaagaaggagccaggagagactctgtcttgcagtaagcacatggatggccaaatgacccaagagaatatttttcctaataggtacggagacgaccctggagaacaactgatggatcctgagctgcaggaactgttcaatgaactgaccaacatatctgtgcctcccatgagtgaccttgaactggagaacatgatcaatgccaccataaagcaggatgacccatttaacattgacttgggtcagcaaagccagaggagcacacctaggccctccttacccatggagaaaatagtgatcaaaagtgaatactcaccgggcttgactcagggcccctcaggctctcctcagctgaggcccccatcagctggccccgcattctccatggccaactctgccctctccacttcgtctccaatcccttcagtccctcagagccaggctcagcctcagacaggctccggagcaagccgggccttgccaagctggcaggaagtatcccatgcccagcagctcaaacagatagctgctaatcgtcagcagcatgcccggatgcagcagcaccagcagcagcaccagcctaccaactggtcagccttgccctcttctgctggaccatcaccaggtccatttgggcaggagaaaatccccagcccttcttttggtcagcagacattcagcccacagagctcccccatgcctggggtagctggcggcagcggccagtcgaaagtaatggctaactacatgtacaaggccggcccctcagcccagggtgggcacctagatgtcctcatgcagcaaaagcctcaggatctcagtcgaagttttattaacaacccgcacccagccatggagccccgtcagggcaacaccaagcctttgtttcattttaactcagatcaagcgaaccagcagatgccttctgttttgccttcccagaacaagccttctctcctacactacacccaacagcaacagcagcaacagcagcagcagcagcagcagcagcagcagcagcagcagcaacagcagcagcagcagcaacagcaacagcaacagcaacagcagagttcaatttcagctcaacaacagcaacagcagcagagctcaatttcagcccaacagcagcagcagcagcaacaacagcagcagcagcagcaacaacaacagcaacaacagcagcagcagcagcagcaacaaccatcttctcagcctgcccaatctctaccaagccagcctttgctaaggtcacctttgccacttcagcaaaagctcctacttcagcaaatgcagaatcagcccattgcaggaatgggataccaagtctcccaacaacagagacaggatcaacactctgtggtaggccagaacacaggccccagtccaagtcctaacccctgctcaaatccaaacactggaagtggttacatgaactcccagcaatcactgttgaatcagcaattgatgggaaagaagcagactctacagaggcagatcatggagcagaaacagcaacttcttctccagcagcagatgctggctgacgcggagaaaattgctccacaagatcagataaaccgacatttgtcaaggccacctccagattataaagaccaaagaagaaatgtgggcaatatgcaaccaactgctcagtattctggtggctcatccacaataagcttaaactctaaccaggctttggcaaacccagtttcaacacacaccattttaactcccaattccagcctcctgtctacttctcacgggacaagaatgccatcattatctacagcagttcagaatatggggatgtatggaaatctgccttgtaatcaacctaacacatacagtgtcacttcaggaatgaatcaattgacccaacagagaaacccaaagcaattgttagcaaatcaaaacaaccctatgatgccacggccacctaccttagggccaagtaataataacaatgtagccacttttggagctggatctgttggtaattcacaacaattgagaccaaatttaacccatagtatggcaagcatgccaccacagagaacatcaaacgtaatgatcacatccaacacaactgcaccaaactgggcctctcaagaaggaacaagcaaacagcaagaagccctgacgtctgcaggagtccgcttccccacaggtacacctgcagcctataccccaaatcagtcactgcaacaggcagtaggtagccagcaattttcccagagggcagtggctcctcctaaccagttaacaccagcagtgcaaatgagacccatgaaccaaatgagccaaacactaaatgggcaaaccatgggtcccctcaggggtctgaatctcagacccaatcagctaagcacacagattttgcctaatttgaatcagtcaggaacagggttgaatcagtcgaggacgggcatcaaccagccaccatccctgacgcccagcaattttccttcacccaaccaaagttccagggcttttcaaggaactgaccacagcagtgacttagcttttgacttcctcagccaacaaaatgataacatgggccctgccctaaacagtgatgctgatttcattgattctttattgaagacagagcctggtaatgatgactggatgaaagacatcaatcttgatgaaatcttggggaacaattcctaaagaagaaagggaagacaatttacaaactccaagcactaaaaggcagtatattacagaaactctgtagaggctgaactgttgatgttcaggtggactacatgaagataacatgcttaaaaatggaaagcagaaagtaactgcagtgatgaacattttggtccaaattcttgttttaaatcttacacctgaaagtaaaatattgggatcacttttccctgtctaaactccaggatacagtatccaatttatccaaacagaactgtggtgtcaatgtgtaattaattgtgtaaaatagccttcccaagtttctttttccctggaaaataaaaaaggtaatagaacttgtagtttatttaaaccccatgtcatgaggaggtactagttccaagcaacaaactccttaatttgctctaatagataggtatggtttaatctttccattgtgtcttttcatttaattttcctgaagcttgcaggatagattgaaatgttataggtttgtttggagtaaccaaacagtatgcaaattaagaaaaagccagagaacctagaaaacatccagtggattacagaatttcttccccatattcactcctcacttttacaattttcccacaatcctctacttcagtgggatgctgtgtctagtgattaaacaaaaatatagagctgtgcaatttgattttggcttccacaacgaatatctgaatccattccaaatgaaattttagatataacaaagacttgtcctaatcatactgaaatattggtgcacacctctctgcattagatttcacttttttaaaaaacccagtggacattgctataaataagatttatttggctacaaataacctgggatgttgcttattatgattgatgcctgctggtttgttcccaagctgagtgaaattgaacctcgtcctccctactcattttgatgactgaggctggtttataagaaaaggaagtttggagaagaaaaccgagattagaaaatatcatgttttggttggagataagaaccagggatggcaagtaccagtgtgtacaaatgtatttcacggagtttgaaggaacgcataatcaagagggaaaacaatttgtccttcattggacgtattatttggatttgggtgagcaacaaaatggaatgtggtctgttaggagcattctgtttgttcttttgtccctgatgtgatgaatcattgccacatgctagatggactcttcatatccaggttttgtccctcagggctgagcactgtattaaagagtttttgttgagtcatttaaccttagtgtccacatccagatcagctgtaaaatggggaagacgtgtgctgatttggaatgaatgcaaaatatcactatcattttcctaattacagaggagcaaaggttatcttcagccctttcagttctatgctcacatattcaaatatcaaatgtaatttagctgaagttatttaataatcaagtctttcaatatctgttcaaagaaaaagaacacactttgaaaattctgcaaagctgtctcccagtctttaaaatgtctggaagcactctccttctttacaataccaacatcactggcccagaatcttccctgtgctagtttgtaaatataaataaattacttgttttgtaaacttttgtaaagaatattttggtagaaatacttcaaacatattctttgggttatatttatacatatgtgaaataaatatactatcaaaaggttatattttatacaaaaagtaaattgctaccttttgtatgctaatatgcaaagttttgtataatatgatggtttatttttagctctacacttaaaccataggtggttgagtgggaacttttgaaaactatcaagaggcttgttagacaaatttatattctgaaacctcaataagaaagcattccaggtttcaatccttgttttttgtcctgctcccaaattcttttttaaacccatagttcttgtgtcttatttgattcttctgctgtgcacattgtattggtccttgttgcatgtagtctactgtgtgttttccgattttataaggcagcatttctccatacaaaaagaaaaaaaatgatgtacatataaacgcttttgttgtatggctcctccatgttactgtatatatctgccagcacttcccagttacactcctgtgagtcagcttatttttaccctaacataaatagtatgttttgtagtagttatcaaatttaagagataaagcaatcagaatgtttggattttcttctatcttaatgtgaatttcataattaatgtctatttattcagctattcattaaaatacaggattctttgggaaaa

SEQ ID NO: 151793 - DNA, 3154 bp, Homo sapiens
  Payload ID: 9879
  Gene Symbol: MAML2
  Gene Name: mastermind-like transcriptional coactivator 2
  ENST ID: ENST00000618849
  CDS Start-End: 1-2961
cagctccagggttccttgaaaagaaaacaggtagttaacctatctcctgccaacagcaagcgacccaatggctttgtggacaactcatttcttgatatcaaaagaattcgtgttggggagaatctctctgcaggacaaggtggcctccaaataaacaatggacaaagtcagattatgtcagggaccttgcctatgagccaagcacccctgcgaaagactaacactctgccatcccatacacattctcctggcaatggcctgtttaacatgggcttaaaggaggtaaagaaggagccaggagagactctgtcttgcagtaagcacatggatggccaaatgacccaagagaatatttttcctaataggtacggagacgaccctggagaacaactgatggatcctgagctgcaggaactgttcaatgaactgaccaacatatctgtgcctcccatgagtgaccttgaactggagaacatgatcaatgccaccataaagcaggatgacccatttaacattgacttgggtcagcaaagccagaggagcacacctaggccctccttacccatggagaaaatagtgatcaaaagtgaatactcaccgggcttgactcagggcccctcaggctctcctcagctgaggcccccatcagctggccccgcattctccatggccaactctgccctctccacttcgtctccaatcccttcagtccctcagagccaggctcagcctcagacaggctccggagcaagccgggccttgccaagctggcaggaagtatcccatgcccagcagctcaaacagatagctgctaatcgtcagcagcatgcccggatgcagcagcaccagcagcagcaccagcctaccaactggtcagccttgccctcttctgctggaccatcaccaggtccatttgggcaggagaaaatccccagcccttcttttggtcagcagacattcagcccacagagctcccccatgcctggggtagctggcggcagcggccagtcgaaagtaatggctaactacatgtacaaggccggcccctcagcccagggtgggcacctagatgtcctcatgcagcaaaagcctcaggatctcagtcgaagttttattaacaacccgcacccagccatggagccccgtcagggcaacaccaagcctttgtttcattttaactcagatcaagcgaaccagcagatgccttctgttttgccttcccagaacaagccttctctcctacactacacccaacagcaacagcagcaacagcagcagcagcagcagcagcagcagcagcagcagcagcaacagcagcagcagcagcaacagcaacagcaacagcaacagcagagttcaatttcagctcaacaacagcaacagcagcagagctcaatttcagcccaacagcagcagcagcagcaacaacagcagcagcagcagcaacaacaacagcaacaacagcagcagcagcagcagcaacaaccatcttctcagcctgcccaatctctaccaagccagcctttgctaaggtcacctttgccacttcagcaaaagctcctacttcagcaaatgcagaatcagcccattgcaggaatgggataccaagtctcccaacaacagagacaggatcaacactctgtggtaggccagaacacaggccccagtccaagtcctaacccctgctcaaatccaaacactggaagtggttacatgaactcccagcaatcactgttgaatcagcaattgatgggaaagaagcagactctacagaggcagatcatggagcagaaacagcaacttcttctccagcagcagatgctggctgacgcggagaaaattgctccacaagatcagataaaccgacatttgtcaaggccacctccagattataaagaccaaagaagaaatgtgggcaatatgcaaccaactgctcagtattctggtggctcatccacaataagcttaaactctaaccaggctttggcaaacccagtttcaacacacaccattttaactcccaattccagcctcctgtctacttctcacgggacaagaatgccatcattatctacagcagttcagaatatggggatgtatggaaatctgccttgtaatcaacctaacacatacagtgtcacttcaggaatgaatcaattgacccaacagagaaacccaaagcaattgttagcaaatcaaaacaaccctatgatgccacggccacctaccttagggccaagtaataataacaatgtagccacttttggagctggatctgttggtaattcacaacaattgagaccaaatttaacccatagtatggcaagcatgccaccacagagaacatcaaacgtaatgatcacatccaacacaactgcaccaaactgggcctctcaagaaggaacaagcaaacagcaagaagccctgacgtctgcaggagtccgcttccccacaggtacacctgcagcctataccccaaatcagtcactgcaacaggcagtaggtagccagcaattttcccagagggcagtggctcctcctaaccagttaacaccagcagtgcaaatgagacccatgaaccaaatgagccaaacactaaatgggcaaaccatgggtcccctcaggggtctgaatctcagacccaatcagctaagcacacagattttgcctaatttgaatcagtcaggaacagggttgaatcagtcgaggacgggcatcaaccagccaccatccctgacgcccagcaattttccttcacccaaccaaagttccagggcttttcaaggaactgaccacagcagtgacttagcttttgacttcctcagccaacaaaatgataacatgggccctgccctaaacagtgatgctgatttcattgattctttattgaagacagagcctggtaatgatgactggatgaaagacatcaatcttgatgaaatcttggggaacaattcctaaagaagaaagggaagacaatttacaaactccaagcactaaaaggcagtatattacagaaactctgtagaggctgaactgttgatgttcaggtggactacatgaagataacatgcttaaaaatggaaagcagaaagtaactgcagtgatgaacattttggtccaaattcttgttttaaatcttacacctgaaagt

SEQ ID NO: 151794 - DNA, 831 bp, Homo sapiens
  Payload ID: 9880
  Gene Symbol: MAML3
  Gene Name: mastermind-like transcriptional coactivator 3
  ENST ID: ENST00000398940
  CDS Start-End: 1-831
atgtctccagcagaacagctcaaacagatggctgcacagcagcaacaaagggccaaactcatgcagcagaaacagcaacagcaacagcagcagcagcagcagcagcagcaacagcactcaaatcagacttcaaattggtctcccttaggacctccctctagtccatatggagcagcttttactgcagaaaaaccaaatagcccaatgatgtacccccaagcctttaacaaccaaaaccctatagtgcctccaatggcaaacaacctgcagaagacaacaatgaataactacctccctcagaatcacatgaatatgatcaatcagcagccaaataacttgggtacaaactccttaaacaaacagcacaatattctgacttatggcaacactaaacccctgacccacttcaatgcagacctgagtcagaggatgacaccaccagtggccaaccccaacaaaaaccccttgatgccgtatatccagcagcagcaacagcagcagcaacagcaacagcagcagcagcagcagcagcagccgccacctccacagctccaggcccccagggcacacctgagcgaagaccagaaacgcctgcttctcatgaagcagaaaggagtgatgaatcagcccatggcttacgctgcacttccatcccacggtcaggtaagtgtgaaagtgacacactcttcgagcagttcttgtggtgcatttgactgtcgatgtgtgatgttctacaagtccactgtagtggggtctaattgcctgcagaaaacctctttacatcctcaggtagtggccaggtttggagtgttctttttccatttctcctaa

SEQ ID NO: 151795 - DNA, 6844 bp, Homo sapiens
  Payload ID: 9880
  Gene Symbol: MAML3
  Gene Name: mastermind-like transcriptional coactivator 3
  Uniprot ID: Q96JK9
  ENST ID: ENST00000509479
  CDS Start-End: 858-4274
actccgctggcatggaggaggaggaggaggtggaggagcgagaggaggaggaggaggcggcggcggcggcggcggcgagcagttgatcattgtgatggtggcaggagcagcggcggcagcggcagcccagccgagcgttaggtgctgctctctgcgcggcgttttgcaaaggacttcaccgatctacttttgcagtcgcctcggactgtccatgtgtttacttcccccagcccgaggattcgatatctaggttcctgtgaaatgcaactgagcagccaaagtactttgagaacacggggcggcataaacaccaaaacttttttgtggaaggaaaatgcaataagcaagcttgccgttttccgatgcggtgtggagtgagtgtgtgtcgcgcgtgtccgcactggaggcatatgcttgtgtgtgtacatggggtgtgtttttcggtatgtagggagaaaatgcttgccaaccaccggaaatctcctggaatttattagaaaataatggattataaaaagaaggcaagcaaggagcggatctccccttgagttgcaacccgatttgctgctggctcagtttgttgtgattctttttgttgataggtgtctgatggtattccgataacgttccccccttttcttccccttgagcttttacagtttaaaaaaaggaaacaaaaaccaccccaaaatctccccccccgtttttttcgccccgtcgggatcgccgtttccatccatgtgcttgcgtctcccccgcgttccacttaaactattttaatccttggacccaaggaggaggctgataggggggtggataaaaaaagttcttccaaaatagtgtgcccggggagcaggatgggggatttcgcagcccccgctgctgccgcgaatggcagtagtatttgcatcaacagtagcctgaacagcagcctcggcggggccgggatcggtgtgaataatactcccaatagtactcccgctgctccgagtagcaatcacccggcagccggtggatgcggcggctccgggggccccggcggcggttcggcggccgttcccaagcacagcaccgtggtggagcggctccgccagcgcatcgagggctgccgtcggcaccacgtcaactgcgagaacaggtaccagcaggctcaggtggagcagctggagctggagcgccgggacaccgtgagcctctaccagcggaccctggagcagagggccaagaaatcgggcgccggcaccggcaaacagcagcacccgagcaaaccccagcaagatgcggaggctgcctcggcggagcagaggaaccacacgctgatcatgctacaagagactgtgaaaaggaagttggaaggagctcgatcaccacttaatggagaccagcagaatggtgcttgtgatgggaatttttctccgactagcaaacgaattcgaaaggacatttctgcggggatggaagccatcaacaatttgcccagtaacatgccactgccttcagcttctcctcttcaccaacttgacctgaaaccttctttgcccttgcagaacagtggaactcacactcctgggcttctagaagatctaagtaagaatggtaggctccctgagattaaacttcctgtcaacggttgcagtgacctggaggatagcttcaccatcttgcagagcaaagacctcaaacaagaacctctcgatgaccctacttgcatagacacatcagaaacatctctttcaaatcagaacaagctgttctcagacattaatctgaatgatcaggagtggcaagaattaatagatgaattggccaacacggttcctgaggatgacatacaggacctgttcaacgaagactttgaagagaagaaggagccagaattctcgcagccagcaactgagacccctctctcccaggagagtgcgagcgtgaagagcgacccctctcactctcccttcgcacatgtctccatgggatctccccaggcgaggccttcttcttctggtcctcccttttctactgtctccacggccactagtttaccttctgttgccagcactcccgcagctccaaaccctgcaagctcaccagcaaactgtgctgtccagtcccctcaaactccaaaccaagcccacactccaggccaagctccacctcggcctggaaatggttatctcctgaatccggcagcagtgacagtggccggttcagcgtcagggcctgtggctgtgcccagctctgacatgtctccagcagaacagctcaaacagatggctgcacagcagcaacaaagggccaaactcatgcagcagaaacagcaacagcaacagcagcagcagcagcagcagcagcagcagcagcagcagcagcagcagcagcagcagcaacagcactcaaatcagacttcaaattggtctcccttaggacctccctctagtccatatggagcagcttttactgcagaaaaaccaaatagcccaatgatgtacccccaagcctttaacaaccaaaaccctatagtgcctccaatggcaaacaacctgcagaagacaacaatgaataactacctccctcagaatcacatgaatatgatcaatcagcagccaaataacttgggtacaaactccttaaacaaacagcacaatattctgacttatggcaacactaaacccctgacccacttcaatgcagacctgagtcagaggatgacaccaccagtggccaaccccaacaaaaaccccttgatgccgtatatccagcagcagcaacagcagcagcaacagcaacagcagcagcagcagcagcagcagccgccacctccacagctccaggcccccagggcacacctgagcgaagaccagaaacgcctgcttctcatgaagcagaaaggagtgatgaatcagcccatggcttacgctgcacttccatcccacggtcaggagcagcatccagttggacttccccgaaccacaggccccatgcagtcctccgtgcccccaggctcaggtggcatggtctcaggagccagtcccgcaggccccggcttcctgggcagccagccccaagcagccatcatgaagcagatgctcattgatcagcgggcccagttgatagagcagcagaagcaacagttcctgcgggagcaaaggcagcagcagcagcagcagcagcagcagattttggcggaacagcagttgcagcaatcacatctaccccggcagcacctccagccacagcggaatccatacccagtgcagcaggtcaatcagtttcaaggttctccccaggatatagcagccgtaagaagccaagcagccctccagagcatgcgaacgtcacggctgatggcacagaacgcaggcatgatgggaataggaccctcccagaaccctgggacgatggccaccgcagctgcgcagtcggagatgggactggccccttatagcaccacgcctaccagccaaccaggaatgtacaatatgagcacaggcatgacccaaatgttgcagcatccaaaccaaagtggcatgagcatcacacataaccaagcccagggaccgaggcaacctgcctctgggcagggggttggaatggtgagtggctttggtcagagcatgctggtgaactcagccattacccagcaacatccacagatgaaagggccagtaggccaggccttgcctaggccccaagcccctccaaggctgcagagccttatgggaacagtccagcaaggagcacaaagctggcaacagaggagcttgcagggcatgcctgggaggactagtggagaattgggaccattcaacaatggcgccagctaccctcttcaagctgggcagccgagactgaccaagcagcacttcccacagggactgagccagtcagtcgtggatgctaacacgggcacagtgaggaccctcaacccagctgccatgggtcggcagatgatgccatcgctcccggggcagcaaggcaccagccaggcgaggccaatggtcatgtctggcctgagccagggagtcccaggcatgccagcgttcagccagcccccagcacagcagcagatacccagtggcagctttgctccaagcagccagagccaagcctatgagcggaatgcccctcaggacgtgtcatacaattacagtggcgacggagctgggggttccttccctggcctcccggacggtgcagaccttgtggactccatcatcaaaggcgggccaggggacgagtggatgcaggagcttgatgaattgtttggtaacccctaatcaagagaggccccaagatccacaactcgagtggttaaagcttaaaaagtgaaaaagaaacaggatgttgacccatccttgttttttgtttttttgacccacgtaaactgagcaaaactgcagctggctgacaatggaagatccaggtgccaatccacagccccaccaggcctcatttcacctgattttcacacagcaatcgagatgagacgccatgcagatcccggctgcgagagagggagacacccggaggagcaggtgggaagatgaagccggccagagcccctctgcccagcatgccctgtgatcgcctggcccagcaggagctgcttcagccgagagggactattacccaagagaggtatcctcagcccctcctgccccaggtcgggagacagcagctttggagacacaaaagagacagagcctcagccagggagagtgagtcccccagaagaggctgggtggttgcacaggccaggtgcacaggttggaaatgcactgaactctgggtgccgagagatgtaaggctttgagacatgctactgaatttggagggcaggcacgaagaacagtgagattgtcaaaaggagacaaccacagatcctacaggactgtctgtctcctgccccatgatgaccctcaggaattgcaaaggctctgctgtcacaaggagagcaggctgagtttggagcagggtccatccggcagtcctgggacggcttccctctgctggtgcccctggtggcagtccctccaggtggggctggagcctgctggcgcccaatacaaaacccatacatccaggtgggtcacatctacttctggcggccgcagggcagggaaacccctactggaccctgtgtgtctgccagcctggagcctttgtctccagccctgcctttattcctccttgcctccacaccagcctccccttgcttctccttacagactatccaagaagtgaagcttatgtctttagggagccttgggcagagtccacataaatgcaggaagaacttagacaatgcctgaaatgcaaaggcgacactggagtcttctttctctaacgtgtagcgttgaatgaatatctgcctggaaccaagagggctgctctgatgtttgggagtcggttttttgtgagccacatctgatatttctgatatccccaggaaggagtggcctggaggtcactggttcaggctccctttgggcgaaatcctgggagtgatgctctaaaaatccacctttcccatcatccctactcatcagaaagacaaatataaaatcccagagaggtggaggagctaaaaaagcaattgctccaccttacaaatttggatagaaaggagatgtagtttatttcatatgggcaaagtagtcctcttccaaagtcctgtacagttgttctctgcaattgacgcacatctgccctaagcgaaatctgtcagaaggaatcaacaaggctccttgcctcccctcccaatcccccttttggaggacttgtggcttcggtgtcgtcctaagtgagagtggcgtgtgcttttttcctgtcccctcctccctccgtgtcctagacgctggctgccttctgtgcactcccaggcagatcactacggaagagtcggagcctgtggggttggactggccacactcagtcctgagaaggcgagttgccatggaaagctgggggcagaggtgtttttggagaggaggcggcaggcaaacattgcctttgacttgctctccgcgtacccggggttgtagagctgctcaggaaggggcaggatgtaaggccagaggtgcctggtgggtgagaagcccaggcaggggctgggcgccctctccgaagaggtggcagcagggtgaccctgaactccccaaatggggagtgatgccactggggaaactgagtggatcaaagagatgaaaccaaaaaaaagcaaacaaacaaatgagaagacacaaaacataattaccttttcctgaaaggtacaggaaataaatatataagcaatgatgagaaactggaggtggctaatggaagtgagacagacaggggtggggggctccattatcttttaaaagcttcctccaaatgctcagtactgggaccaactaataggtagattttaatatggtggttttgttttggttttgtttttactacggtgctgatgtatatgtaatgtctaaaaaaagttatttgtacataagtttttacaatactgcagatatcactgggtctactatctgtaaaaaatatacatataaatatatatatactgtttgtttaaaatagagtatttttatttcattccttaactcatcatcacagcagtggtattgcacttcagatgacatctaattactaatttgtactgtatgacctctggcaacttgctccattttattcagatttttctagttttctgtttttactttgtacattgagcattgcttatttccttttaagaaatgtacagaacgctgaaatgtagaaatgaagtgatgttgacataccacttttaaagaaaacaaaaacaaaaataaaagattatctgaatcaa

SEQ ID NO: 151796 - DNA, 559 bp, Homo sapiens
  Payload ID: 9880
  Gene Symbol: MAML3
  Gene Name: mastermind-like transcriptional coactivator 3
  ENST ID: ENST00000502696
  CDS Start-End: 1-559
agagggccaagaaatcgggcgccggcaccggcaaacagcagcacccgagcaaaccccagcaagatgcggaggctgcctcggcggagcagaggaaccacacgctgatcatggagcagcatccagttggacttccccgaaccacaggccccatgcagtcctccgtgcccccaggctcaggtggcatggtctcaggagccagtcccgcaggccccggcttcctgggcagccagccccaagcagccatcatgaagcagatgctcattgatcagcgggcccagttgatagagcagcagaagcaacagttcctgcgggagcaaaggcagcagcagcagcagcagcagcagcagattttggcggaacagcagttgcagcaatcacatctaccccggcagcacctccagccacagcggaatccatacccagtgcagcaggtcaatcagtttcaaggttctccccaggatatagcagccgtaagaagccaagcagccctccagagcatgcgaacgtcacggctgatggcacagaacgcaggcatgatgggaataggaccctcccagaa

SEQ ID NO: 151797 - DNA, 2485 bp, Homo sapiens
  Payload ID: 9881
  Gene Symbol: MELK
  Gene Name: maternal embryonic leucine zipper kinase
  Uniprot ID: Q14680
  ENST ID: ENST00000298048
  CDS Start-End: 185-2140
gagatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatata

SEQ ID NO: 151798 - DNA, 2363 bp, Homo sapiens
  Payload ID: 9881
  Gene Symbol: MELK
  Gene Name: maternal embryonic leucine zipper kinase
  Uniprot ID: Q14680
  ENST ID: ENST00000541717
  CDS Start-End: 185-2017
gagatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatatag

SEQ ID NO: 151799 - DNA, 2125 bp, Homo sapiens
  Payload ID: 9881
  Gene Symbol: MELK
  Gene Name: maternal embryonic leucine zipper kinase
  Uniprot ID: Q14680
  ENST ID: ENST00000536987
  CDS Start-End: 219-1781
acaacccggcgatcgaaaagattcttaggaacgccgtaccagccgcgtctctcaggacagcaggcccctgtccttctgtcgggcgccgctcagccgtgccctccgcccctcagagtgatttgccccggatcaaaacggagattgaggccttgaagaacctgagacatcagcatatatgtcaactctaccatgtgctagagacagccaacaaaatattcatggttcttgaggaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatat

SEQ ID NO: 151800 - DNA, 2342 bp, Homo sapiens
  Payload ID: 9881
  Gene Symbol: MELK
  Gene Name: maternal embryonic leucine zipper kinase
  Uniprot ID: Q14680
  ENST ID: ENST00000536860
  CDS Start-End: 185-1996
gagatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgaggaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatatag

SEQ ID NO: 151801 - DNA, 2400 bp, Homo sapiens
  Payload ID: 9881
  Gene Symbol: MELK
  Gene Name: maternal embryonic leucine zipper kinase
  Uniprot ID: Q14680
  ENST ID: ENST00000543751
  CDS Start-End: 195-2054
gagatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacagagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatatag

SEQ ID NO: 151802 - DNA, 2283 bp, Homo sapiens
  Payload ID: 9881
  Gene Symbol: MELK
  Gene Name: maternal embryonic leucine zipper kinase
  Uniprot ID: Q14680
  ENST ID: ENST00000536329
  CDS Start-End: 195-1937
gagatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatatag

SEQ ID NO: 151803 - DNA, 2236 bp, Homo sapiens
  Payload ID: 9881
  Gene Symbol: MELK
  Gene Name: maternal embryonic leucine zipper kinase
  Uniprot ID: Q14680
  ENST ID: ENST00000545008
  CDS Start-End: 150-1892
aacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatat

SEQ ID NO: 151804 - DNA, 2263 bp, Homo sapiens
  Payload ID: 9881
  Gene Symbol: MELK
  Gene Name: maternal embryonic leucine zipper kinase
  ENST ID: ENST00000627766
  CDS Start-End: 347-844
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacagagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagagatggagtttcactgtgtcgcccaggctggagtacagtggcgtgatctcggctcactgcaacctccgactcttggattcaagcgattctcctgcctcagccttccgagtagctgggactgcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattgg

SEQ ID NO: 151805 - DNA, 1966 bp, Homo sapiens
  Payload ID: 9881
  Gene Symbol: MELK
  Gene Name: maternal embryonic leucine zipper kinase
  ENST ID: ENST00000626154
  CDS Start-End: 184-573
gtaccagccgcgtctctcaggacagcaggcccctgtccttctgtcgggcgccgctcagccgtgccctccgcccctcagagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataacgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgatttt

SEQ ID NO: 151806 - DNA, 918 bp, Homo sapiens
  Payload ID: 9881
  Gene Symbol: MELK
  Gene Name: maternal embryonic leucine zipper kinase
  ENST ID: ENST00000625974
  CDS Start-End: 209-682
gatcgaaaagattcttaggaacgccgtaccagccgcgtctctcaggacagcaggcccctgtccttctgtcgggcgccgctcagccgtgccctccgcccctcagagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggctggagtacagtggcgtgatctcggctcactgcaacctccgactcttggattcaagcgattctcctgcctcagccttccgagtagctgggactgcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacag

SEQ ID NO: 151807 - DNA, 794 bp, Homo sapiens
  Payload ID: 9881
  Gene Symbol: MELK
  Gene Name: maternal embryonic leucine zipper kinase
  ENST ID: ENST00000495529
  CDS Start-End: 150-794
aacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgaggaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatc

SEQ ID NO: 151808 - DNA, 3832 bp, Homo sapiens
  Payload ID: 9882
  Gene Symbol: MATN1
  Gene Name: matrilin 1, cartilage matrix protein
  Uniprot ID: P21941
  ENST ID: ENST00000373765
  CDS Start-End: 37-1527
acaaccgtgccggctgctgcccgtgctgccagaactatgagggtcctctctggcactagcctcatgctctgcagcctgctgctgctgctccaggccctgtgcagccctggcctcgccccccagtccagaggccatctctgccggacgcggcccacagacctggtgtttgttgtcgacagctctcgcagcgttcggcctgttgaatttgagaaagtgaaggtattcctgtcccaggtcatcgagtcgctggacgtggggcccaatgccacccgggtgggcatggtcaactatgccagcaccgtgaagcaggagttctcgctgcgggctcatgtctccaaggccgcactgctgcaggctgtgcgccgtatccagccgctgtccacaggcaccatgaccggcctggccatccagttcgctatcaccaaagccttcggcgatgcagagggtggtcgttccaggtcccctgacatcagcaaggtggtcatcgtggtgacagacgggaggccccaggacagcgtgcaggacgtgtctgcgcgggcccgggccagcggcgtcgagctgttcgccatcggagtgggcagcgtggacaaggccacgctgcggcagatcgccagcgagccgcaggacgaacacgtcgattacgtggagagctacagcgtcatcgagaagctgtccaggaagttccaggaggccttctgcgtggtgtcagacctgtgcgccacaggggaccatgactgtgagcaggtgtgcatcagctcccccggttcctacacctgcgcctgccacgagggcttcactctgaacagcgacggcaagacctgcaatgtctgcagtggtggtggtggcagctcggccactgacctggtcttcctcattgacggatccaagagtgtgaggccagagaactttgagctggtgaagaagttcatcagtcagatcgtggatacgctggacgtgtcagacaagctggcccaggtggggctggtgcagtactcaagctctgtgcgccaggagttccccctgggtcgcttccacaccaagaaggacatcaaggcggctgtgcggaatatgtcctacatggagaagggcacaatgactggggctgctctcaagtacctcattgacaattccttcactgtgtccagtggggctaggcccggggcccagaaggtgggcattgtcttcactgatggccggagccaggactacattaatgatgctgccaagaaggccaaagacctcggctttaagatgtttgctgtgggtgtgggcaatgccgtggaggatgagctgagggaaatagcctcagagcctgtggcagagcactacttctacacggctgacttcaagaccatcaaccagataggcaagaagttgcagaagaagatctgtgtggaggaagacccgtgtgcctgcgagtccctggtgaaattccaagccaaagtggaggggctgctgcaggccctgaccaggaaactggaagctgtgagtaagcggctggccatcctggagaacacagttgtctaaggctgcctgtcaccactgtggcctctccaagcgtcctgcacgtgtccgccgtagctttaccattttagtgagggaagccagcccgggggtgggagggggtgtgtctgggtgtgcctattgagagcgtgtaatggcgtttgggagctcgtgtgtgtatgtgtgcgtgtgtgtatgtgtgcatgtgtgtgtgtgtgtgtgtgtgtgcacgtgcgcctgagggtgggcatgagtcttgccagaatgtgagtgtgagagtgataatgcaggggtgagtgtgagagggactgcgtttgcatttttataatcaaaagcttaatatattcccatcttttttagttaaccctttcttgactctgagtgctgtgaatttctttactgatttctctattctccggtgagaaacaattaaatgtgatttaacgtaagcagtgaatggggctagaggcagtgtggttatttggggaccagggaaaaggatggatgaagatgtggtgggaggggatggttggaaggatggtaacagtggtggtgacagtgatgacagtgaccacaccaaaaccagctggtgtttgtcctgccttttcagttacatattcatttagttgacctcatttcacttccagtaaccttacccagaaaagactcaaattatccccattacaaatgggaaagctgagagtctaaatgatgaaatgacttgctcagcagtgggtcgctgagagacaggacttgaatctaggactgaagaacatcaaaagaaaaaggcttcagagaaaaagggcaatgacaccagataggactcatttgttcattcattcattcgttcactcattcgttcaggtatcatgtacttacagggcaatggcggtggggggggatggtgctgtatgagacagacgtagttcctgccctaagagacatacagttgagcagggtgctcatgtcacccccaccagccagagggaccagccagaggaaaagagagtgggtttaggtcgtaccaggggtttgtgcctcctcttgatacctgggagcccacggggtgagtgtgtgtgtgagatgatgggaagggctccagcctgggcctgggctgccctaggtgcctctcccctcccgcccccaacatgccctgttggagttctgtttgtttcctgtgcacaggcggcatcacccccaacccaaagtccccaacgcagatggcagcagccccacctcagagactgcacaagagaaagactcctggccccatgttcccttcctccagccctatgtggggtctgcaggtcacaccctgagatctcggccacctcccccaggcccctgttggaccagtgctgctccggaatctccatctctgtcctctcagagggggagctttggtgattttctgaacctattcttgtttaatggagcatttttagtgttactactagattcacacttgagagcatgtctaaaaggcttttacaagaagctcagaccacaccgaaagatcttcctcggaggcagttcaaagaggcagaataacaacacgaacggtacccaagagctacatcagtacaacagcacaaatacacaagcgcgacttaactggggcacagccaccctcgcccccatgacctgactccacctcctacacagttcaccaaaccctttctctctgtccgtccctggggcaggagtttttctgctgtccaaggaggctccttgacacagccacctgagaagttatgactctgctcattcttcctttcttctgagattatccactcccctctcctccccacacaggtggggagggggagaggcagccatgttgatatggactgagaaggctcagcagtgtgtccccaaggaggaggagagggtcattagcggacgccatggcctgggagctggcgggcagaagcaacagatgtccctgatgagtggagtcagagatggggtggaagccctgcctgggaataggacctcgttcttccctgcccggtgggtggagtagtggcaggaccttgtcaccaggctctgatgaaggcagggaccagcttcttgggatctttcaatcccaaactcttgcccttcactcatcgcagttctccccacggctactccaggtcctcttgaaatccgtcctctccatggacttcccacatccctctctgctctaggtttgattaacagaaggttgtaaatgaaaaccagcatctcccgagggcagccatggtctactgacagatggcaagttactttgtaacctgtaattttgtttttttgaattttgtataaataaacaggactaaactaa

SEQ ID NO: 151809 - DNA, 4106 bp, Homo sapiens
  Payload ID: 9883
  Gene Symbol: MATN2
  Gene Name: matrilin 2
  Uniprot ID: O00339
  ENST ID: ENST00000254898
  CDS Start-End: 232-3102
gcgagcgaagggagcgctctgggatgggacttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccatatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagagaatggtattcagtgcaaaaattcttagtttaactttaaatggaagatatgtatgtatgagaaatggccaacatgcctatgaaaaaaatgctgaatctcatcagtaatcaggaaaatgcaggttaaaacaataccatttttcacccatcagcttagcaaaaatgagtatattttttaacaagtgttggtaaggatgtggaaatgtgaggttcttgtagtaagaatgcaaatggcactctttgtagagtaagtctgttgacatctcataaaactgaaaatgcacacaaccctgtaaatctagcaactgcactcagttgatttcagcccatacatacaaagagacctgcataagaatgttactaggctttgtaaaagcaaaaaataaggaacaacttaaacatcatcagaaggggaactgataaactctggtgtaatccataccacagaaatacaacaccgcatgtacaggaatgtgctacatctatacaaataaatggtcaaactc

SEQ ID NO: 151810 - DNA, 2731 bp, Homo sapiens
  Payload ID: 9883
  Gene Symbol: MATN2
  Gene Name: matrilin 2
  Uniprot ID: O00339
  ENST ID: ENST00000522025
  CDS Start-End: 211-2229
agctggggctccgtcctcgcctcccacgagcgatccccgaggagagccgcggccctcggcgaggcgaagaggccgacgaggaagacccgggtggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagagaa

SEQ ID NO: 151811 - DNA, 600 bp, Homo sapiens
  Payload ID: 9883
  Gene Symbol: MATN2
  Gene Name: matrilin 2
  ENST ID: ENST00000519585
  CDS Start-End: 255-600
aggtgatggctggtgggttcagagtaattaagactgatggataactgcagagaggaaatctagttttcagggcaaacagatgcgtccaagagagagcccacacacgtggttggatgcagctggagatggagaattccagttcaaggaaaaggcctgggcagtatgtgtttggtggtggtcgttgaccctgaaaatagatggaatcttggagggagaaagcgagtgtggaaagtgaagtccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacct

SEQ ID NO: 151812 - DNA, 997 bp, Homo sapiens
  Payload ID: 9883
  Gene Symbol: MATN2
  Gene Name: matrilin 2
  ENST ID: ENST00000521952
  CDS Start-End: 1-467
gggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaagtaagatgtctgcaaatcaacccaccatggctgcgaacacatttgtgttaataatgggaattcctacatctgcaaatgctcagagggatttgttctagctgaggacggaagacggtgcaagagtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgaga

SEQ ID NO: 151813 - DNA, 416 bp, Homo sapiens
  Payload ID: 9883
  Gene Symbol: MATN2
  Gene Name: matrilin 2
  ENST ID: ENST00000522135
  CDS Start-End: 1-395
tagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgctatatccttttcttgcattatgcttctgtatggaatgcaaagaatattatcaaaacttcacacactctatgtaggttttatcaactgaagtaaatcccacgaagtcacaaagaa

SEQ ID NO: 151814 - DNA, 2663 bp, Homo sapiens
  Payload ID: 9883
  Gene Symbol: MATN2
  Gene Name: matrilin 2
  ENST ID: ENST00000518154
  CDS Start-End: 1-2161
ggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccatatgtgcagcaccctggagcataactgtgcccacttctgcatcaacatccctggctcatacgtctgcaggtgcaaacaaggctacattctcaactcggatcagacgacttgcagaactgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagagaa

SEQ ID NO: 151815 - DNA, 586 bp, Homo sapiens
  Payload ID: 9883
  Gene Symbol: MATN2
  Gene Name: matrilin 2
  ENST ID: ENST00000522270
  CDS Start-End: 1-586
cagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaagtctgcccttcttcccctcagggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtg

SEQ ID NO: 151816 - DNA, 548 bp, Homo sapiens
  Payload ID: 9883
  Gene Symbol: MATN2
  Gene Name: matrilin 2
  ENST ID: ENST00000517321
  CDS Start-End: 1-548
ggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggag

SEQ ID NO: 151817 - DNA, 3554 bp, Homo sapiens
  Payload ID: 9883
  Gene Symbol: MATN2
  Gene Name: matrilin 2
  Uniprot ID: O00339
  ENST ID: ENST00000521689
  CDS Start-End: 475-3288
gatgcccgcctgggctcaggcacggacggagtggagccaggtggcagcaggcagggcgcgccgccagagtgcccagctcccggggctgcccacagggtggggccgccctcgccgccgctccctctccgcgccttccccatccccaaagaggacacccctccttccgcccggcccgctccccacccccgccgcggcaccgcctccccagccgcccgcccttgcccagcgcctcccaggcagccagcgagcgaagggagcgctctgggatgggacttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccatatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatact

SEQ ID NO: 151818 - DNA, 3449 bp, Homo sapiens
  Payload ID: 9883
  Gene Symbol: MATN2
  Gene Name: matrilin 2
  Uniprot ID: O00339
  ENST ID: ENST00000524308
  CDS Start-End: 204-2951
acttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccatatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcag

SEQ ID NO: 151819 - DNA, 640 bp, Homo sapiens
  Payload ID: 9883
  Gene Symbol: MATN2
  Gene Name: matrilin 2
  ENST ID: ENST00000519582
  CDS Start-End: 1-530
gttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaacagagatcttctctatcggcactctaaaaaatgaaacactccaccaagggaacagcaggatccaatgattcatttaaacaatattaaataaaaggaatgcttggggataataaagaaaagaggattcggtgctttta

SEQ ID NO: 151820 - DNA, 541 bp, Homo sapiens
  Payload ID: 9883
  Gene Symbol: MATN2
  Gene Name: matrilin 2
  ENST ID: ENST00000521041
  CDS Start-End: 1-541
gtccattgggagtgagccccatgaggaccatgtcttccttgtggccaatttcagccagattgagacgctgacctccgtgttccagaagaagttgtgcatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgc

SEQ ID NO: 151821 - DNA, 3495 bp, Homo sapiens
  Payload ID: 9883
  Gene Symbol: MATN2
  Gene Name: matrilin 2
  Uniprot ID: O00339
  ENST ID: ENST00000520016
  CDS Start-End: 125-2995
gaactctgaaaaggcggggcagcgggcctgcagctcctggagttcagggagacccggaaatctcaccctgccctcttcttgtgttgtgtttgtcacagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccatatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagag

SEQ ID NO: 151822 - DNA, 2524 bp, Homo sapiens
  Payload ID: 9884
  Gene Symbol: MATN3
  Gene Name: matrilin 3
  Uniprot ID: O15232
  ENST ID: ENST00000407540
  CDS Start-End: 64-1524
aaatccgagcctcgcgtgggctcctggcccccgacggacaccaccaggcccacggagcccaccatgccgcgcccggcccccgcgcgccgcctcccgggactcctcctgctgctctggccgctgctgctgctgccctccgccgcccccgaccccgtggcccgcccgggcttccggaggctggagacccgaggtcccgggggcagccctggacgccgcccctctcctgcggctcccgacggcgcgcccgcttccgggaccagcgagcctggccgcgcccgcggtgcaggtgtttgcaagagcagacccttggacctggtgtttatcattgatagttctcgtagcgtacggcccctggaattcaccaaagtgaaaacttttgtctcccggataatcgacactctggacattgggccagccgacacgcgggtggcagtggtgaactatgctagcactgtgaagatcgagttccaactccaggcctacacagataagcagtccctgaagcaggccgtgggtcgaatcacacccttgtcaacaggcaccatgtcaggcctagccatccagacagcaatggacgaagccttcacagtggaggcaggggctcgagagccctcttctaacatccctaaggtggccatcattgttacagatgggaggccccaggaccaggtgaatgaggtggcggctcgggcccaagcatctggtattgagctctatgctgtgggcgtggaccgggcagacatggcgtccctcaagatgatggccagtgagcccctagaggagcatgttttctacgtggagacctatggggtcattgagaaactttcctctagattccaggaaaccttctgtgcgctggacccctgtgtgcttggaacacaccagtgccagcacgtctgcatcagtgatggggaaggcaagcaccactgtgagtgtagccaaggatacaccttgaatgccgacaagaaaacgtgttcagctcttgataggtgtgctcttaacacccacggatgtgagcacatctgtgtgaatgacagaagtggctcttatcattgtgagtgctatgaaggttataccttgaatgaagacaggaaaacttgttcagctcaagataaatgtgctttgggtacccatgggtgtcagcacatttgtgtgaatgacagaacagggtcccatcattgtgaatgctatgagggctacactctgaatgcagataaaaaaacatgttcagtccgtgacaagtgtgccctaggctctcatggttgccagcacatttgtgtgagtgatggggccgcatcctaccactgtgattgctatcctggctacaccttaaatgaggacaagaaaacatgttcagccactgaggaagcacgaagacttgtttccactgaagatgcttgtggatgtgaagctacactggcattccaggacaaggtcagctcgtatcttcaaagactgaacactaaacttgatgacattttggagaagttgaaaataaatgaatatggacaaatacatcgttaaattgctccaatttctcacctgaaaatgtggacagcttggtgtacttaatactcatgcattcttttgcacacctgttattgccaatgttcctgctaataatttgccattatctgtattaatgcttgaatattactggataaattgtatgaagatcttctgcagaatcagcatgattcttccaaggaaatacatatgcagatacttattaagagcaaactttagtgtctctaagttatgactgtgaaatgattggtaggaaatagaatgaaaagtttagtgtttctttatctactaattgagccatttaatttttaaatgtttatattagataaccatattcacaatggaaactttaggtctagtttcttttgatagtatttataatataaatcaatcttattactgagagtgcaaattgtacaaggtatttacacatacaacttcatataactgagatgaatgtaattttgaactgtttaacactttttgttttttgcttattttgttggagtattattgaagatgtgatcaatagattgtaatacacatatctaaaaatagttaacacagatcaagtgaacattacattgccatttttaattcattctggtctttgaaagaaatgtactactaaagagcactagttgtgaatttagggtgttaaactttttaccaagtacaaaaatcccaaattcactttattattttgcttcaggatccaagtgacaaagttatatatttataaaattgctataaatcgacaaaatctaatgttgtctttttaatgttagtgatccacctgcctcagcctcccaaagtgctgggattacaggcttgaaagtctaacttttttttacttatatatttgatacatataattcttttggctttgaaacttgcaactttgagaacaaaacagtcctttaaattttgcactgctcaattctgtttttcgtttgcattgtctttaatataataaaagttattacctttacatatt

SEQ ID NO: 151823 - DNA, 1443 bp, Homo sapiens
  Payload ID: 9884
  Gene Symbol: MATN3
  Gene Name: matrilin 3
  Uniprot ID: O15232
  ENST ID: ENST00000421259
  CDS Start-End: 35-1369
cccgacggacaccaccaggcccacggagcccaccatgccgcgcccggcccccgcgcgccgcctcccgggactcctcctgctgctctggccgctgctgctgctgccctccgccgcccccgaccccgtggcccgcccgggcttccggaggctggagacccgaggtcccgggggcagccctggacgccgcccctctcctgcggctcccgacggcgcgcccgcttccgggaccagcgagcctggccgcgcccgcggtgcaggtgtttgcaagagcagacccttggacctggtgtttatcattgatagttctcgtagcgtacggcccctggaattcaccaaagtgaaaacttttgtctcccggataatcgacactctggacattgggccagccgacacgcgggtggcagtggtgaactatgctagcactgtgaagatcgagttccaactccaggcctacacagataagcagtccctgaagcaggccgtgggtcgaatcacacccttgtcaacaggcaccatgtcaggcctagccatccagacagcaatggacgaagccttcacagtggaggcaggggctcgagagccctcttctaacatccctaaggtggccatcattgttacagatgggaggccccaggaccaggtgaatgaggtggcggctcgggcccaagcatctggtattgagctctatgctgtgggcgtggaccgggcagacatggcgtccctcaagatgatggccagtgagcccctagaggagcatgttttctacgtggagacctatggggtcattgagaaactttcctctagattccaggaaaccttctgtgctcttgataggtgtgctcttaacacccacggatgtgagcacatctgtgtgaatgacagaagtggctcttatcattgtgagtgctatgaaggttataccttgaatgaagacaggaaaacttgttcagctcaagataaatgtgctttgggtacccatgggtgtcagcacatttgtgtgaatgacagaacagggtcccatcattgtgaatgctatgagggctacactctgaatgcagataaaaaaacatgttcagtccgtgacaagtgtgccctaggctctcatggttgccagcacatttgtgtgagtgatggggccgcatcctaccactgtgattgctatcctggctacaccttaaatgaggacaagaaaacatgttcagccactgaggaagcacgaagacttgtttccactgaagatgcttgtggatgtgaagctacactggcattccaggacaaggtcagctcgtatcttcaaagactgaacactaaacttgatgacattttggagaagttgaaaataaatgaatatggacaaatacatcgttaaattgctccaatttctcacctgaaaatgtggacagcttggtgtacttaatactcatgcattcttttgcacacctg

SEQ ID NO: 151824 - DNA, 1657 bp, Homo sapiens
  Payload ID: 9885
  Gene Symbol: MATN4
  Gene Name: matrilin 4
  ENST ID: ENST00000353917
  CDS Start-End: 158-1657
ctgcctggcagtccccacctagggcacgctgccacgccgccgttacctggtccaagtgcccgggaggctccgcctgtcggcttcgctctgcagctgcatctctgatctgtcctgcaggctcaggctctgacacctccattctctgtccccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtga

SEQ ID NO: 151825 - DNA, 2127 bp, Homo sapiens
  Payload ID: 9885
  Gene Symbol: MATN4
  Gene Name: matrilin 4
  Uniprot ID: O95460
  ENST ID: ENST00000360607
  CDS Start-End: 188-1810
aaatgcggccgttgcctctgtgtgctccagctgcctggcagtccccacctagggcacgctgccacgccgccgttacctggtccaagtgcccgggaggctccgcctgtcggcttcgctctgcagctgcatctctgatctgtcctgcaggctcaggctctgacacctccattctctgtccccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttcca

SEQ ID NO: 151826 - DNA, 2200 bp, Homo sapiens
  Payload ID: 9885
  Gene Symbol: MATN4
  Gene Name: matrilin 4
  Uniprot ID: O95460
  ENST ID: ENST00000372754
  CDS Start-End: 10-1878
ccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgggaaggaccagtgtgctgaggggggacatggttgccagcaccaatgtgtcaatgcctgggccatgttccactgcacctgcaacccaggctacaagctagcagcagataacaagagctgtttggccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacgggg

SEQ ID NO: 151827 - DNA, 2077 bp, Homo sapiens
  Payload ID: 9885
  Gene Symbol: MATN4
  Gene Name: matrilin 4
  Uniprot ID: O95460
  ENST ID: ENST00000372756
  CDS Start-End: 10-1755
ccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacgggg

SEQ ID NO: 151828 - DNA, 1991 bp, Homo sapiens
  Payload ID: 9885
  Gene Symbol: MATN4
  Gene Name: matrilin 4
  Uniprot ID: O95460
  ENST ID: ENST00000537548
  CDS Start-End: 246-1991
agtgtggctgccccggtctccccagtctcccgctgtagctgaattccagcctggcccgcagctagccctgtctgcagctccaagcgtgctgcctggcagtccccacctagggcacgctgccacgccgccgttacctggtccaagtgcccgggaggctccgcctgtcggcttcgctctgcagctgcatctctgatctgtcctgcaggctcaggctctgacacctccattctctgtccccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtga

SEQ ID NO: 151829 - DNA, 4843 bp, Homo sapiens
  Payload ID: 9886
  Gene Symbol: MATR3
  Gene Name: matrin 3
  Uniprot ID: P43243
  ENST ID: ENST00000394805
  CDS Start-End: 336-2879
gtgggggcgagctctctcgcgagagtgggtttgttcttgggctgcagccgctgccgccgcttctcgccagcgccgttgctgcgggggattgtgggagtctccgcgtcccgctcgctgggagagaggtacctctccttttccctctccctttccctaagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgtaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgca

SEQ ID NO: 151830 - DNA, 770 bp, Homo sapiens
  Payload ID: 9886
  Gene Symbol: MATR3
  Gene Name: matrin 3
  ENST ID: ENST00000504023
  CDS Start-End: 538-770
agtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctaggtgtttatcctgctctgtggccctgttctgtggaatattcctattggatcagttacagttttttagccagatatttctagaacggttatggtggttctgaaatggctagtctttcgggcgcgctggaataatgtgaagaatcgttgatttcgtagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtac

SEQ ID NO: 151831 - DNA, 1001 bp, Homo sapiens
  Payload ID: 9886
  Gene Symbol: MATR3
  Gene Name: matrin 3
  ENST ID: ENST00000515833
  CDS Start-End: 1-1001
gagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaa

SEQ ID NO: 151832 - DNA, 561 bp, Homo sapiens
  Payload ID: 9886
  Gene Symbol: MATR3
  Gene Name: matrin 3
  ENST ID: ENST00000508689
  CDS Start-End: 327-561
gtatgtgagccgcctgatcggcggccgccatgttaggagcgcagtggcggcgcaaccagccttctagggcggcggaggtgagcggtccgggagggaaacacgcggccggccaagggcccagggtgcggcgggagattttgggtgaagagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtactt

SEQ ID NO: 151833 - DNA, 696 bp, Homo sapiens
  Payload ID: 9886
  Gene Symbol: MATR3
  Gene Name: matrin 3
  ENST ID: ENST00000503340
  CDS Start-End: 435-696
gtggaacaagccgcctgcagtacagtgcgaggcgggtgatttgcacttgtttagtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatattta

SEQ ID NO: 151834 - DNA, 447 bp, Homo sapiens
  Payload ID: 9886
  Gene Symbol: MATR3
  Gene Name: matrin 3
  ENST ID: ENST00000511249
  CDS Start-End: 83-447
tgtgggagtctccgcgtcccgctcgctgggagagaggtacctctccttttccctctccctttccctaagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaa

SEQ ID NO: 151835 - DNA, 423 bp, Homo sapiens
  Payload ID: 9886
  Gene Symbol: MATR3
  Gene Name: matrin 3
  ENST ID: ENST00000504311
  CDS Start-End: 95-423
gccgttgctgcgggggattgtgggagtctccgcgtcccgctcgctgggagagagctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctca

SEQ ID NO: 151836 - DNA, 1530 bp, Homo sapiens
  Payload ID: 9886
  Gene Symbol: MATR3
  Gene Name: matrin 3
  ENST ID: ENST00000504045
  CDS Start-End: 231-1530
cgccgttgctgcgggggattgtgggagtctccgcgtcccgctcgctgggagagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaa

SEQ ID NO: 151837 - DNA, 2518 bp, Homo sapiens
  Payload ID: 9886
  Gene Symbol: MATR3
  Gene Name: matrin 3
  Uniprot ID: P43243
  ENST ID: ENST00000503811
  CDS Start-End: 232-1911
gcgtcccgctcgctgggagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctg

SEQ ID NO: 151838 - DNA, 444 bp, Homo sapiens
  Payload ID: 9886
  Gene Symbol: MATR3
  Gene Name: matrin 3
  ENST ID: ENST00000513678
  CDS Start-End: 187-444
gttcttgggctgcagccgctgccgccgcttctcgccagcgccgttgctgcgggggattgtgggagtctccgcgtcccgctcgctgggagagaggtacctctccttttccctctccctttccctaaggagtggagtcaacatatcaatggagcaagtcacagtcgtcgatgccagcttcttcttgaaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtc

SEQ ID NO: 151839 - DNA, 575 bp, Homo sapiens
  Payload ID: 9886
  Gene Symbol: MATR3
  Gene Name: matrin 3
  ENST ID: ENST00000512876
  CDS Start-End: 202-575
gggtttgttcttgggctgcagccgctgccgccgcttctcgccagcgccgttgctgcgggggattgtgggagtctccgcgtcccgctcgctgggagagaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttgg

SEQ ID NO: 151840 - DNA, 455 bp, Homo sapiens
  Payload ID: 9886
  Gene Symbol: MATR3
  Gene Name: matrin 3
  ENST ID: ENST00000511378
  CDS Start-End: 429-455
tctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatct

SEQ ID NO: 151841 - DNA, 2664 bp, Homo sapiens
  Payload ID: 9886
  Gene Symbol: MATR3
  Gene Name: matrin 3
  ENST ID: ENST00000502499
  CDS Start-End: 125-1654
gttgctgcgggggattgtgggagtctccgcgtcccgctcgctgggagagaggtacctctccttttccctctccctttccctaagctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggcca

SEQ ID NO: 151842 - DNA, 3040 bp, Homo sapiens
  Payload ID: 9886
  Gene Symbol: MATR3
  Gene Name: matrin 3
  ENST ID: ENST00000510056
  CDS Start-End: 254-2638
gggggattgtgggagtctccgcgtcccgctcgctgggagagaggtacctctccttttccctctccctttccctaagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttgaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaata

SEQ ID NO: 151843 - DNA, 564 bp, Homo sapiens
  Payload ID: 9886
  Gene Symbol: MATR3
  Gene Name: matrin 3
  ENST ID: ENST00000514488
  CDS Start-End: 265-564
atcgcgtaaaaatggccgaaaaatgaaacgttaacgcttgtttttcgtactgcgtcgtggaacaagccgcctgcagtacagtgcgagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaa

SEQ ID NO: 151844 - DNA, 532 bp, Homo sapiens
  Payload ID: 9886
  Gene Symbol: MATR3
  Gene Name: matrin 3
  ENST ID: ENST00000514528
  CDS Start-End: 17-532
ctgatcggcggccgccatgttaggagcgcagtggcggcgcaaccagccttctagggcggcggaggtgagcggtccgggagggaaacacgcggccggccaagggcccagggtgcggcgggagattttgggtgaagaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgag

SEQ ID NO: 151845 - DNA, 3970 bp, Homo sapiens
  Payload ID: 9887
  Gene Symbol:
  Gene Name: matrin 3 [Source:EntrezGene
  Acc:9782]
  ENST ID: ENST00000361059
  CDS Start-End: 428-2971
ctttcccctccggcctctgccggtgctgctgcgccctgcggagctccgaacacgtgcgcagaggctggctgtggcagatgcaactgcaggatgacttgaaagtagggcatccttcacccatctgaagggaggaaatagtggcaggtgacagtctgcatgtgcagttttcagatgccttcacctgaatgacatctacctccatcaggaccccagatgtctgacagccctgtgtgacaccaagataagtaacagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaa

SEQ ID NO: 151846 - DNA, 5513 bp, Homo sapiens
  Payload ID: 9887
  Gene Symbol:
  Gene Name: matrin 3 [Source:EntrezGene
  Acc:9782]
  ENST ID: ENST00000394800
  CDS Start-End: 550-3237
tttcccctccggcctctgccggtgctgctgcgccctgcggagctccgaacacgtgcgcagaggctggctgtggcagatgcaactgcaggatgacttgaaagtagggcatccttcacccatctgaagggaggaaatagtggcaggtgacagtctgcatgtgcagttttcagatgccttcacctgaatgacatctacctccatcaggaccccagatgtctgacagccctgtgtgacaccaagataagtaacgaggttgacaaacagccttttcgggaatgggactcgaactcgtaagccacgtctgttcctccatttcccgcctcagctggatgacggagagggatctccgggattaaagaacaacgaccgcagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaagcgtcgttttccagggagtatggaaggttttgtcactctagatgaggttggtgatgaggaagattcggaacttcagaaacttcgtaaatcgggcatggcatttaaatctggtgacaaaaatgatgatggtttggttgaaattaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgtaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatggagttcttcagtgtttcctttcagtgatggctttttcatagcttcaactttgttggatttagcaagttgaaggaaagaatgctatgtttttaatacctacatttgagagcatttagaaatcagaaattataataagctgttagtgataaatctgtaacagcccttcgattacgagaaaacctctttttagtaggaatgtttccactcatgtttgctgtaaagtttaagaacatttttcctacggctatgtcagcccttagtttaatcttacattatcctacaaaagtgaatgaaacttctagaagta

SEQ ID NO: 151847 - DNA, 2243 bp, Homo sapiens
  Payload ID: 9887
  Gene Symbol:
  Gene Name: matrin 3 [Source:EntrezGene
  Acc:9782]
  ENST ID: ENST00000504203
  CDS Start-End: 352-1881
tttcccctccggcctctgccggtgctgctgcgccctgcggagctccgaacacgtgcgcagaggctggctgtggcagatgcaactgcaggatgacttgaaagtagggcatccttcacccatctgaagggaggaaatagtggcaggtgacagtctgcatgtgcagttttcagatgccttcacctgaatgacatctacctccatcaggaccccagatgtctgacagccctgtgtgacaccaagataagtaacgagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattca

SEQ ID NO: 151848 - DNA, 750 bp, Homo sapiens
  Payload ID: 9887
  Gene Symbol:
  Gene Name: matrin 3 [Source:EntrezGene
  Acc:9782]
  ENST ID: ENST00000509644
  CDS Start-End: 508-750
ggtgctgctgcgccctgcggagctccgaacacgtgcgcagaggctggctgtggcagatgcaactgcaggatgacttgaaagtagggcatccttcacccatctgaagggaggaaatagtggcaggtgacagtctgcatgtgcagttttcagatcccaatcgcagtgcttggcacatggcaggacctccctgaatgttgcataaaacaactgaaaacacagaaggggattcctgttaaagggtttgacaacagggtctgcaattagtgcttccacgcctgttttgcagtcaatattcaactgatacgtcttctacctggagtgcctagatgccttcacctgaatgacatctacctccatcaggaccccagatgtctgacagccctgtgtgacaccaagataagtaacgagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggta

SEQ ID NO: 151849 - DNA, 587 bp, Homo sapiens
  Payload ID: 9887
  Gene Symbol:
  Gene Name: matrin 3 [Source:EntrezGene
  Acc:9782]
  ENST ID: ENST00000514694
  CDS Start-End: 266-587
tttcccctccggcctctgccggtgctgctgcgccctgcggagctccgaacacgtgcgcagaggctggctgtggcagatgcaactgcagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccagg

SEQ ID NO: 151850 - DNA, 4373 bp, Homo sapiens
  Payload ID: 9887
  Gene Symbol:
  Gene Name: matrin 3 [Source:EntrezGene
  Acc:9782]
  ENST ID: ENST00000502929
  CDS Start-End: 653-3340
tttcccctccggcctctgccggtgctgctgcgccctgcggagctccgaacacgtgcgcagaggctggctgtggcagatgcaactgcaggatgacttgaaagtagggcatccttcacccatctgaagggaggaaatagtggcaggtgacagtctgcatgtgcagttttcagatgccttcacctgaatgacatctacctccatcaggaccccagatgtctgacagccctgtgtgacaccaagataagtaactgtctgactctgtagcccaggctggagtgtgcagtggtgcactaggctcacggcaacctccgcctccggctcaaacgatcctcagccccgtcctccgtaccaggaggttgacaaacagccttttcgggaatgggactcgaactcgtaagccacgtctgttcctccatttcccgcctcagctggatgacggagagggatctccgggattaaagaacaacgaccgcagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaagcgtcgttttccagggagtatggaaggttttgtcactctagatgaggttggtgatgaggaagattcggaacttcagaaacttcgtaaatcgggcatggcatttaaatctggtgacaaaaatgatgatggtttggttgaaattaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttg

SEQ ID NO: 151851 - DNA, 580 bp, Homo sapiens
  Payload ID: 9887
  Gene Symbol:
  Gene Name: matrin 3 [Source:EntrezGene
  Acc:9782]
  ENST ID: ENST00000506147
  CDS Start-End: 392-580
agcgttccgggggcgctcagtgtgggcaggcaggaagcctggctccactaggacacacagattctctcctgagcagctgcgaactatgcgccccttctacccttaagagatgggatgggagtccaacaaacccagccattgctcagaccccagcccttctctcctctaagaagcaggttcacctctgccaccgcactcgcatttttttttttttttaaagcccggcctttcctaggcggggtcaagggccccgcccaccgaagccacgcccagtagccgccccggggcggggttcccctcggctcccggctgccctttcccctccggcctctgccggtgctgctgcgccctgcggagctccgaacacgtgcgcagaggctggctgtggcagatgcaactgcaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcattt

SEQ ID NO: 151852 - DNA, 3249 bp, Homo sapiens
  Payload ID: 9887
  Gene Symbol:
  Gene Name: matrin 3 [Source:EntrezGene
  Acc:9782]
  Uniprot ID: P43243
  ENST ID: ENST00000509990
  CDS Start-End: 697-3240
gcagcaacggaaaggcgccacgctcgtgagcggaaccagcgttccgggggcgctcagtgtgggcaggcaggaagcctggctccactaggacacacagattctctcctgagcagctgcgaactatgcgccccttctacccttaagagatgggatgggagtccaacaaacccagccattgctcagaccccagcccttctctcctctaagaagcaggttcacctctgccaccgcactcgcatttttttttttttttaaagcccggcctttcctaggcggggtcaagggccccgcccaccgaagccacgcccagtagccgccccggggcggggttcccctcggctcccggctgccctttcccctccggcctctgccggtgctgctgcgccctgcggagctccgaacacgtgcgcagaggctggctgtggcagatgcaactgcagatgccttcacctgaatgacatctacctccatcaggaccccagatgtctgacagccctgtgtgacaccaagataagtaacagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaa

SEQ ID NO: 151853 - DNA, 579 bp, Homo sapiens
  Payload ID: 9887
  Gene Symbol:
  Gene Name: matrin 3 [Source:EntrezGene
  Acc:9782]
  ENST ID: ENST00000512107
  CDS Start-End: 560-579
aggacacacagattctctcctgagcagctgcgaactatgcgccccttctacccttaagagatgggatgggagtccaacaaacccagccattgctcagaccccagcccttctctcctctaagaagcaggttcacctctgccaccgcactcgcatttttttttttttttaaagcccggcctttcctaggcggggtcaagggccccgcccaccgaagccacgcccagtagccgccccggggcggggttcccctcggctcccggctgccctttcccctccggcctctgccggtgctgctgcgccctgcggagctccgaacacgtgcgcgtgaagaggctggctgtggcagatgcaactgcaggatgacttgaaagtagggcatccttcacccatctgaagggaggaaatagtggcaggtgacagtctgcatgtgcagttttcagatgccttcacctgaatgacatctacctccatcaggaccccagatgtctgacagccctgtgtgacaccaagataagtaacctacccagaatggaatcctgacaatgatacaggacacacaatgggtgatccattcatgtt

SEQ ID NO: 151854 - DNA, 664 bp, Homo sapiens
  Payload ID: 9887
  Gene Symbol:
  Gene Name: matrin 3 [Source:EntrezGene
  Acc:9782]
  ENST ID: ENST00000505016
  CDS Start-End: 524-664
ctgcgccctgcggagctccgaacacgtgcgcagaggctggctgtggcagatgcaactgcaggatgacttgaaagtagggcatccttcacccatctgaagggaggaaatagtggcaggtgacagtctgcatgtgcagttttcagatgccttcacctgaatgacatctacctccatcaggaccccagatgtctgacagccctgtgtgacaccaagataagtaacaatctggctgctgactaccctattggacaactccaatattagagaacatttccaccaattcagaaagtttattatgcactgctgttctagagcagggatcagcaaacttgctgtaaagagccagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccag

SEQ ID NO: 151855 - DNA, 589 bp, Homo sapiens
  Payload ID: 9887
  Gene Symbol:
  Gene Name: matrin 3 [Source:EntrezGene
  Acc:9782]
  ENST ID: ENST00000502394
  CDS Start-End: 291-589
gtttcattgcagagaggctggctgtggcagatgcaactgcaggtgccgtcatttaatttcccagacacttgacctccttctgatttgtgtactccctccaaggctgagttgcaagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctca

SEQ ID NO: 151856 - DNA, 3134 bp, Homo sapiens
  Payload ID: 9887
  Gene Symbol:
  Gene Name: matrin 3 [Source:EntrezGene
  Acc:9782]
  ENST ID: ENST00000620916
  CDS Start-End: 1-852
atgtccaagtcattccagcagtcatctctcagtagggactcacagggtcatgggcgtgacctgtctgcggcaggaataggccttcttgctgctgctacccagtctttaagtatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaagcgtcgttttccagggagtatggaaggttttgtcactctagatgaggttggtgatgaggaagattcggaacttcagaaacttcgtaaatcgggcatggcatttaaatctggtgacaaaaatgatgatggtttggttgaaattaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgtaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatggagttcttcagtgtttcctttcagtgatggctttttcatagcttcaactttgttggatttagcaagttgaaggaaagaatgctatgtttttaatacctacatttgagagcatttagaaatcagaaattataataagctgttagtgataaatctgtaacagcccttcgattacgagaaaacctctttttagtaggaatgtttccactcatgtttgctgtaaagtttaagaacatttttcctacggctatgtcagcccttagtttaatcttacattatcctacaaaagtgaatgaaacttctagaagtaccttga

SEQ ID NO: 151857 - DNA, 5282 bp, Homo sapiens
  Payload ID: 9887
  Gene Symbol:
  Gene Name: matrin 3 [Source:EntrezGene
  Acc:9782]
  Uniprot ID: P43243
  ENST ID: ENST00000618441
  CDS Start-End: 457-3000
gcgtcccgctcgctgggagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgtaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatggagttcttcagtgtttcctttcagtgatggctttttcatagcttcaactttgttggatttagcaagttgaaggaaagaatgctatgtttttaatacctacatttgagagcatttagaaatcagaaattataataagctgttagtgataaatctgtaacagcccttcgattacgagaaaacctctttttagtaggaatgtttccactcatgtttgctgtaaagtttaagaacatttttcctacggctatgtcagcccttagtttaatcttacattatcctacaaaagtgaatgaaacttctagaagtaccttga

SEQ ID NO: 151858 - DNA, 1986 bp, Homo sapiens
  Payload ID: 9888
  Gene Symbol: MEPE
  Gene Name: matrix extracellular phosphoglycoprotein
  Uniprot ID: Q9NQ76
  ENST ID: ENST00000361056
  CDS Start-End: 41-1618
caggtattctgaaggtgaaagataccagagattctcaaagatgcgagttttctgtgtgggactactccttttcagtgtgacctgggcagcaccaacatttcaaccacagactgagaaaactaagcaaagctgtgtggaagagcagaggcaggaagaaaaaaacaaagacaatattggttttcaccatttgggcaagagaataaatcaagagctatcatctaaagaaaatattgtccaggaaagaaagaaagatttgtccctttctgaagccagtgagaataagggaagtagtaaatctcaaaattatttcacaaatagacagagactgaataaagaatatagtatcagtaacaaagagaatactcacaatggcctgaggatgtcaatttatcctaagtcaactgggaataaagggtttgaggatggagatgatgctatcagcaaactacatgaccaagaagaatatggcgcagctctcatcagaaataacatgcaacatataatggggccagtgactgcgattaaactcctgggggaagaaaacaaagagaacacacctaggaatgttctaaacataatcccagcaagtatgaattatgctaaagcacactcgaaggataaaaagaagcctcaaagagattcccaagcccagaaaagtccagtaaaaagcaaaagcacccatcgtattcaacacaacattgactacctaaaacatctctcaaaagtcaaaaaaatccccagtgattttgaaggcagcggttatacagatcttcaagagagaggggacaatgatatatctcctttcagtggggacggccaaccttttaaggacattcctggtaaaggagaagctactggtcctgacctagaaggcaaagatattcaaacagggtttgcaggcccaagtgaagctgagagtactcatcttgacacaaaaaagccaggttataatgagatcccagagagagaagaaaatggtggaaataccattggaactagggatgaaactgcgaaagaggcagatgctgttgatgtcagccttgtagagggcagcaacgatatcatgggtagtaccaattttaaggagctccctggaagagaaggaaacagagtggatgctggcagccaaaatgctcaccaagggaaggttgagtttcattaccctcctgcaccctcaaaagagaaaagaaaagaaggcagtagtgatgcagctgaaagtaccaactataatgaaattcctaaaaatggcaaaggcagtaccagaaagggtgtagatcattctaataggaaccaagcaaccttaaatgaaaaacaaaggtttcctagtaagggcaaaagtcagggcctgcccattccttctcgtggtcttgataatgaaatcaaaaacgaaatggattcctttaatggccccagtcatgagaatataataacacatggcagaaaatatcattatgtaccccacagacaaaataattctacacggaataagggtatgccacaagggaaaggctcctggggtagacaaccccattccaacaggaggtttagttcccgtagaagggatgacagtagtgagtcatctgacagtggcagttcaagtgagagcgatggtgactagtccaccaggagttcccagcggggtgacagtctgaagacctcgtcacctgtgagttgatgtagaggagagccacctgacagctgaccaggtgaagagaggatagagtgaagaactgagtgagccaagaatcctggtctccttgggggaatttttgctatcttaatagtcacagtataaaattctattaaaggctataatgtttttaagcaaaaaaaaatcattacagatctatgaaataggtaacatttgagtaggtgtcatttaaaaatagttggtgaatgtcacaaatgccttctatgttgtttgctctgtagacatgaaaataaacaatatctctcgatgataatttgtattaagtaatctataag

SEQ ID NO: 151859 - DNA, 2123 bp, Homo sapiens
  Payload ID: 9888
  Gene Symbol: MEPE
  Gene Name: matrix extracellular phosphoglycoprotein
  Uniprot ID: Q9NQ76
  ENST ID: ENST00000395102
  CDS Start-End: 111-1781
cattgggaactctaacaaactttaaatttcagcaaaatgcccagagacttctaatcctgcaacaagaagccaggtattctgaaggtgaaagataccagagattctcaaagatgcgagttttctgtgtgggactactccttttcagtgtgacctgggcagcaccaacatttcaaccacagactgagaaaactaagcaaagctgtgtggaagagcagaggataacatacaagggtcactatgagaaacatgggcattatgtttttaagtgtgtttacatgtcacctgagaagaaaaatcaaactgatgtaaagcaggaagaaaaaaacaaagacaatattggttttcaccatttgggcaagagaataaatcaagagctatcatctaaagaaaatattgtccaggaaagaaagaaagatttgtccctttctgaagccagtgagaataagggaagtagtaaatctcaaaattatttcacaaatagacagagactgaataaagaatatagtatcagtaacaaagagaatactcacaatggcctgaggatgtcaatttatcctaagtcaactgggaataaagggtttgaggatggagatgatgctatcagcaaactacatgaccaagaagaatatggcgcagctctcatcagaaataacatgcaacatataatggggccagtgactgcgattaaactcctgggggaagaaaacaaagagaacacacctaggaatgttctaaacataatcccagcaagtatgaattatgctaaagcacactcgaaggataaaaagaagcctcaaagagattcccaagcccagaaaagtccagtaaaaagcaaaagcacccatcgtattcaacacaacattgactacctaaaacatctctcaaaagtcaaaaaaatccccagtgattttgaaggcagcggttatacagatcttcaagagagaggggacaatgatatatctcctttcagtggggacggccaaccttttaaggacattcctggtaaaggagaagctactggtcctgacctagaaggcaaagatattcaaacagggtttgcaggcccaagtgaagctgagagtactcatcttgacacaaaaaagccaggttataatgagatcccagagagagaagaaaatggtggaaataccattggaactagggatgaaactgcgaaagaggcagatgctgttgatgtcagccttgtagagggcagcaacgatatcatgggtagtaccaattttaaggagctccctggaagagaaggaaacagagtggatgctggcagccaaaatgctcaccaagggaaggttgagtttcattaccctcctgcaccctcaaaagagaaaagaaaagaaggcagtagtgatgcagctgaaagtaccaactataatgaaattcctaaaaatggcaaaggcagtaccagaaagggtgtagatcattctaataggaaccaagcaaccttaaatgaaaaacaaaggtttcctagtaagggcaaaagtcagggcctgcccattccttctcgtggtcttgataatgaaatcaaaaacgaaatggattcctttaatggccccagtcatgagaatataataacacatggcagaaaatatcattatgtaccccacagacaaaataattctacacggaataagggtatgccacaagggaaaggctcctggggtagacaaccccattccaacaggaggtttagttcccgtagaagggatgacagtagtgagtcatctgacagtggcagttcaagtgagagcgatggtgactagtccaccaggagttcccagcggggtgacagtctgaagacctcgtcacctgtgagttgatgtagaggagagccacctgacagctgaccaggtgaagagaggatagagtgaagaactgagtgagccaagaatcctggtctccttgggggaatttttgctatcttaatagtcacagtataaaattctattaaaggctataatgtttttaagcaaaaaaaaatcattacagatctatgaaataggtaacatttgagtaggtgtcatttaaaaatagttggtgaatgtcacaaatgccttctatgttgtttgctctgtagacatgaaaataaacaatatctctcgatg

SEQ ID NO: 151860 - DNA, 2022 bp, Homo sapiens
  Payload ID: 9888
  Gene Symbol: MEPE
  Gene Name: matrix extracellular phosphoglycoprotein
  Uniprot ID: Q9NQ76
  ENST ID: ENST00000424957
  CDS Start-End: 74-1651
atgcagtgctcccctggcctgccggcagctatccacaccagaaagaggaaaaggtagactgagattctcaaagatgcgagttttctgtgtgggactactccttttcagtgtgacctgggcagcaccaacatttcaaccacagactgagaaaactaagcaaagctgtgtggaagagcagaggcaggaagaaaaaaacaaagacaatattggttttcaccatttgggcaagagaataaatcaagagctatcatctaaagaaaatattgtccaggaaagaaagaaagatttgtccctttctgaagccagtgagaataagggaagtagtaaatctcaaaattatttcacaaatagacagagactgaataaagaatatagtatcagtaacaaagagaatactcacaatggcctgaggatgtcaatttatcctaagtcaactgggaataaagggtttgaggatggagatgatgctatcagcaaactacatgaccaagaagaatatggcgcagctctcatcagaaataacatgcaacatataatggggccagtgactgcgattaaactcctgggggaagaaaacaaagagaacacacctaggaatgttctaaacataatcccagcaagtatgaattatgctaaagcacactcgaaggataaaaagaagcctcaaagagattcccaagcccagaaaagtccagtaaaaagcaaaagcacccatcgtattcaacacaacattgactacctaaaacatctctcaaaagtcaaaaaaatccccagtgattttgaaggcagcggttatacagatcttcaagagagaggggacaatgatatatctcctttcagtggggacggccaaccttttaaggacattcctggtaaaggagaagctactggtcctgacctagaaggcaaagatattcaaacagggtttgcaggcccaagtgaagctgagagtactcatcttgacacaaaaaagccaggttataatgagatcccagagagagaagaaaatggtggaaataccattggaactagggatgaaactgcgaaagaggcagatgctgttgatgtcagccttgtagagggcagcaacgatatcatgggtagtaccaattttaaggagctccctggaagagaaggaaacagagtggatgctggcagccaaaatgctcaccaagggaaggttgagtttcattaccctcctgcaccctcaaaagagaaaagaaaagaaggcagtagtgatgcagctgaaagtaccaactataatgaaattcctaaaaatggcaaaggcagtaccagaaagggtgtagatcattctaataggaaccaagcaaccttaaatgaaaaacaaaggtttcctagtaagggcaaaagtcagggcctgcccattccttctcgtggtcttgataatgaaatcaaaaacgaaatggattcctttaatggccccagtcatgagaatataataacacatggcagaaaatatcattatgtaccccacagacaaaataattctacacggaataagggtatgccacaagggaaaggctcctggggtagacaaccccattccaacaggaggtttagttcccgtagaagggatgacagtagtgagtcatctgacagtggcagttcaagtgagagcgatggtgactagtccaccaggagttcccagcggggtgacagtctgaagacctcgtcacctgtgagttgatgtagaggagagccacctgacagctgaccaggtgaagagaggatagagtgaagaactgagtgagccaagaatcctggtctccttgggggaatttttgctatcttaatagtcacagtataaaattctattaaaggctataatgtttttaagcaaaaaaaaatcattacagatctatgaaataggtaacatttgagtaggtgtcatttaaaaatagttggtgaatgtcacaaatgccttctatgttgtttgctctgtagacatgaaaataaacaatatctctcgatgataatttgtattaagtaatctataagaaa

SEQ ID NO: 151861 - DNA, 550 bp, Homo sapiens
  Payload ID: 9888
  Gene Symbol: MEPE
  Gene Name: matrix extracellular phosphoglycoprotein
  ENST ID: ENST00000511670
  CDS Start-End: 51-341
aacaagaagccaggtattctgaaggtgaaagataccagagattctcaaagatgcgagttttctgtgtgggactactccttttcagtgtgacctgggcagcaccaacatttcaaccacagactgagaaaactaagcaaagctgtgtggaagagcagagggctcctcaagcctctctactacaaaactctgggtcccagaatcttcctgatccccatcccatgcctcggcccacatctcgctctgcttcaggacctgtggctgcaggtgtgatactcatggacctcagcaggaagaaaaaaacaaagacaatattggttttcaccatttgggcaagagaataaatcaagagctatcatctaaagaaaatattgtccaggaaagaaagaaagatttgtccctttctgaagccagtgagaataagggaagtagtaaatctcaaaattatttcacaaatagacagagactgaataaagaatatagtatcagtaacaaagagaatactcacaatggcctgaggatgtcaatttatcctaagtcaactgggaataaa

SEQ ID NO: 151862 - DNA, 2226 bp, Homo sapiens
  Payload ID: 9888
  Gene Symbol: MEPE
  Gene Name: matrix extracellular phosphoglycoprotein
  ENST ID: ENST00000497649
  CDS Start-End: 379-1884
aaaatgcccagagacttctaatcctgcaacaagaagccaggtattctgaaggtgaaagataccagagattctcaaagatgcgagttttctgtgtgggactactccttttcagtgtgacctgggcagcaccagggttctctcttttatatgattgatccaccatgatgcctgcttccactgtagcacacccattcaaacacggcccagtccgcccattggttcccagtgccacatctgagataggctaggagtttctgaaagaaagagacatttcaaccacagactgagaaaactaagcaaagctgtgtggaagagcagaggataacatacaagggtcactatgagaaacatgggcattatgtttttaagtgtgtttacatgtcacctgagaagaaaaatcaaactgatgtaaagcaggaagaaaaaaacaaagacaatattggttttcaccatttgggcaagagaataaatcaagagctatcatctaaagaaaatattgtccaggaaagaaagaaagatttgtccctttctgaagccagtgagaataagggaagtagtaaatctcaaaattatttcacaaatagacagagactgaataaagaatatagtatcagtaacaaagagaatactcacaatggcctgaggatgtcaatttatcctaagtcaactgggaataaagggtttgaggatggagatgatgctatcagcaaactacatgaccaagaagaatatggcgcagctctcatcagaaataacatgcaacatataatggggccagtgactgcgattaaactcctgggggaagaaaacaaagagaacacacctaggaatgttctaaacataatcccagcaagtatgaattatgctaaagcacactcgaaggataaaaagaagcctcaaagagattcccaagcccagaaaagtccagtaaaaagcaaaagcacccatcgtattcaacacaacattgactacctaaaacatctctcaaaagtcaaaaaaatccccagtgattttgaaggcagcggttatacagatcttcaagagagaggggacaatgatatatctcctttcagtggggacggccaaccttttaaggacattcctggtaaaggagaagctactggtcctgacctagaaggcaaagatattcaaacagggtttgcaggcccaagtgaagctgagagtactcatcttgacacaaaaaagccaggttataatgagatcccagagagagaagaaaatggtggaaataccattggaactagggatgaaactgcgaaagaggcagatgctgttgatgtcagccttgtagagggcagcaacgatatcatgggtagtaccaattttaaggagctccctggaagagaaggaaacagagtggatgctggcagccaaaatgctcaccaagggaaggttgagtttcattaccctcctgcaccctcaaaagagaaaagaaaagaaggcagtagtgatgcagctgaaagtaccaactataatgaaattcctaaaaatggcaaaggcagtaccagaaagggtgtagatcattctaataggaaccaagcaaccttaaatgaaaaacaaaggtttcctagtaagggcaaaagtcagggcctgcccattccttctcgtggtcttgataatgaaatcaaaaacgaaatggattcctttaatggccccagtcatgagaatataataacacatggcagaaaatatcattatgtaccccacagacaaaataattctacacggaataagggtatgccacaagggaaaggctcctggggtagacaaccccattccaacaggaggtttagttcccgtagaagggatgacagtagtgagtcatctgacagtggcagttcaagtgagagcgatggtgactagtccaccaggagttcccagcggggtgacagtctgaagacctcgtcacctgtgagttgatgtagaggagagccacctgacagctgaccaggtgaagagaggatagagtgaagaactgagtgagccaagaatcctggtctccttgggggaatttttgctatcttaatagtcacagtataaaattctattaaaggctataatgtttttaagcaaaaaaaaatcattacagatctatgaaataggtaacatttgagtaggtgtcatttaaaaatagttggtgaatgtcacaaatgccttctatgttgtttgctctgtagacatgaaaataaacaatatctctcgatg

SEQ ID NO: 151863 - DNA, 2135 bp, Homo sapiens
  Payload ID: 9888
  Gene Symbol: MEPE
  Gene Name: matrix extracellular phosphoglycoprotein
  Uniprot ID: Q9NQ76
  ENST ID: ENST00000540395
  CDS Start-End: 526-1764
aatcctgcaacaagaagccaggtattctgaaggtgaaagataccagagattctcaaagatgcgagttttctgtgtgggactactccttttcagtgtgacctgggcagcaccaacatttcaaccacagactgagaaaactaagcaaagctgtgtggaagagcagagggctcctcaagcctctctactacaaaactctgggtcccagaatcttcctgatccccatcccatgcctcggcccacatctcgctctgcttcaggacctgtggctgcaggtgtgatactcatggacctcagcaggaagaaaaaaacaaagacaatattggttttcaccatttgggcaagagaataaatcaagagctatcatctaaagaaaatattgtccaggaaagaaagaaagatttgtccctttctgaagccagtgagaataagggaagtagtaaatctcaaaattatttcacaaatagacagagactgaataaagaatatagtatcagtaacaaagagaatactcacaatggcctgaggatgtcaatttatcctaagtcaactgggaataaagggtttgaggatggagatgatgctatcagcaaactacatgaccaagaagaatatggcgcagctctcatcagaaataacatgcaacatataatggggccagtgactgcgattaaactcctgggggaagaaaacaaagagaacacacctaggaatgttctaaacataatcccagcaagtatgaattatgctaaagcacactcgaaggataaaaagaagcctcaaagagattcccaagcccagaaaagtccagtaaaaagcaaaagcacccatcgtattcaacacaacattgactacctaaaacatctctcaaaagtcaaaaaaatccccagtgattttgaaggcagcggttatacagatcttcaagagagaggggacaatgatatatctcctttcagtggggacggccaaccttttaaggacattcctggtaaaggagaagctactggtcctgacctagaaggcaaagatattcaaacagggtttgcaggcccaagtgaagctgagagtactcatcttgacacaaaaaagccaggttataatgagatcccagagagagaagaaaatggtggaaataccattggaactagggatgaaactgcgaaagaggcagatgctgttgatgtcagccttgtagagggcagcaacgatatcatgggtagtaccaattttaaggagctccctggaagagaaggaaacagagtggatgctggcagccaaaatgctcaccaagggaaggttgagtttcattaccctcctgcaccctcaaaagagaaaagaaaagaaggcagtagtgatgcagctgaaagtaccaactataatgaaattcctaaaaatggcaaaggcagtaccagaaagggtgtagatcattctaataggaaccaagcaaccttaaatgaaaaacaaaggtttcctagtaagggcaaaagtcagggcctgcccattccttctcgtggtcttgataatgaaatcaaaaacgaaatggattcctttaatggccccagtcatgagaatataataacacatggcagaaaatatcattatgtaccccacagacaaaataattctacacggaataagggtatgccacaagggaaaggctcctggggtagacaaccccattccaacaggaggtttagttcccgtagaagggatgacagtagtgagtcatctgacagtggcagttcaagtgagagcgatggtgactagtccaccaggagttcccagcggggtgacagtctgaagacctcgtcacctgtgagttgatgtagaggagagccacctgacagctgaccaggtgaagagaggatagagtgaagaactgagtgagccaagaatcctggtctccttgggggaatttttgctatcttaatagtcacagtataaaattctattaaaggctataatgtttttaagcaaaaaaaaatcattacagatctatgaaataggtaacatttgagtaggtgtcatttaaaaatagttggtgaatgtcacaaatgccttctatgttgtttgctctgtagacatgaaaataaacaatatctctcgatgataatttgtattaagtaatctataagaaa

SEQ ID NO: 151864 - DNA, 2206 bp, Homo sapiens
  Payload ID: 9888
  Gene Symbol: MEPE
  Gene Name: matrix extracellular phosphoglycoprotein
  Uniprot ID: Q9NQ76
  ENST ID: ENST00000560249
  CDS Start-End: 597-1835
aatcctgcaacaagaagccaggtattctgaaggtgaaagataccagagattctcaaagatgcgagttttctgtgtgggactactccttttcagtgtgacctgggcagcaccaacatttcaaccacagactgagaaaactaagcaaagctgtgtggaagagcagaggataacatacaagggtcactatgagaaacatgggcattatgtttttaagtgtgtttacatgtcacctgagaagaaaaatcaaactgatgtaaaggctcctcaagcctctctactacaaaactctgggtcccagaatcttcctgatccccatcccatgcctcggcccacatctcgctctgcttcaggacctgtggctgcagcaggaagaaaaaaacaaagacaatattggttttcaccatttgggcaagagaataaatcaagagctatcatctaaagaaaatattgtccaggaaagaaagaaagatttgtccctttctgaagccagtgagaataagggaagtagtaaatctcaaaattatttcacaaatagacagagactgaataaagaatatagtatcagtaacaaagagaatactcacaatggcctgaggatgtcaatttatcctaagtcaactgggaataaagggtttgaggatggagatgatgctatcagcaaactacatgaccaagaagaatatggcgcagctctcatcagaaataacatgcaacatataatggggccagtgactgcgattaaactcctgggggaagaaaacaaagagaacacacctaggaatgttctaaacataatcccagcaagtatgaattatgctaaagcacactcgaaggataaaaagaagcctcaaagagattcccaagcccagaaaagtccagtaaaaagcaaaagcacccatcgtattcaacacaacattgactacctaaaacatctctcaaaagtcaaaaaaatccccagtgattttgaaggcagcggttatacagatcttcaagagagaggggacaatgatatatctcctttcagtggggacggccaaccttttaaggacattcctggtaaaggagaagctactggtcctgacctagaaggcaaagatattcaaacagggtttgcaggcccaagtgaagctgagagtactcatcttgacacaaaaaagccaggttataatgagatcccagagagagaagaaaatggtggaaataccattggaactagggatgaaactgcgaaagaggcagatgctgttgatgtcagccttgtagagggcagcaacgatatcatgggtagtaccaattttaaggagctccctggaagagaaggaaacagagtggatgctggcagccaaaatgctcaccaagggaaggttgagtttcattaccctcctgcaccctcaaaagagaaaagaaaagaaggcagtagtgatgcagctgaaagtaccaactataatgaaattcctaaaaatggcaaaggcagtaccagaaagggtgtagatcattctaataggaaccaagcaaccttaaatgaaaaacaaaggtttcctagtaagggcaaaagtcagggcctgcccattccttctcgtggtcttgataatgaaatcaaaaacgaaatggattcctttaatggccccagtcatgagaatataataacacatggcagaaaatatcattatgtaccccacagacaaaataattctacacggaataagggtatgccacaagggaaaggctcctggggtagacaaccccattccaacaggaggtttagttcccgtagaagggatgacagtagtgagtcatctgacagtggcagttcaagtgagagcgatggtgactagtccaccaggagttcccagcggggtgacagtctgaagacctcgtcacctgtgagttgatgtagaggagagccacctgacagctgaccaggtgaagagaggatagagtgaagaactgagtgagccaagaatcctggtctccttgggggaatttttgctatcttaatagtcacagtataaaattctattaaaggctataatgtttttaagcaaaaaaaaatcattacagatctatgaaataggtaacatttgagtaggtgtcatttaaaaatagttggtgaatgtcacaaatgccttctatgttgtttgctctgtagacatgaaaataaacaatatctctcgatgataatttgtattaagtaatctataagaaa

SEQ ID NO: 151865 - DNA, 694 bp, Homo sapiens
  Payload ID: 9889
  Gene Symbol: MGP
  Gene Name: matrix Gla protein
  Uniprot ID: P08493
  ENST ID: ENST00000228938
  CDS Start-End: 67-453
cccgtaggagcctctctccctactgctgctacacaagaccctgagactgacctgcaggacgaaaccatgaagagcctgatccttcttgccatcctggccgccttagcggtagtaactttgtgttatggagagtggcagaaagaagaaaacttcggctttgatatcgtttcagttctctctctgaactggcatcgtgcccaggaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattacagaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgat

SEQ ID NO: 151866 - DNA, 423 bp, Homo sapiens
  Payload ID: 9889
  Gene Symbol: MGP
  Gene Name: matrix Gla protein
  ENST ID: ENST00000545199
  CDS Start-End: 1-224
aatcacatgaaagcatggaatcttatgaacttagatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattacagaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttca

SEQ ID NO: 151867 - DNA, 1405 bp, Homo sapiens
  Payload ID: 9889
  Gene Symbol: MGP
  Gene Name: matrix Gla protein
  Uniprot ID: P08493
  ENST ID: ENST00000539261
  CDS Start-End: 136-447
tctcccactggttcctcccctctcaactgctctggttcttataaaaacctcacagccttccactaacatcccgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattacagaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttcttttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaag

SEQ ID NO: 151868 - DNA, 1970 bp, Homo sapiens
  Payload ID: 9890
  Gene Symbol: MMP1
  Gene Name: matrix metallopeptidase 1
  Uniprot ID: P03956
  ENST ID: ENST00000315274
  CDS Start-End: 69-1478
atattggagcagcaagaggctgggaagccatcacttaccttgcactgagaaagaagacaaaggccagtatgcacagctttcctccactgctgctgctgctgttctggggtgtggtgtctcacagcttcccagcgactctagaaacacaagagcaagatgtggacttagtccagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccagatgtggagtgcctgatgtggctcagtttgtcctcactgaggggaaccctcgctgggagcaaacacatctgacctacaggattgaaaattacacgccagatttgccaagagcagatgtggaccatgccattgagaaagccttccaactctggagtaatgtcacacctctgacattcaccaaggtctctgagggtcaagcagacatcatgatatcttttgtcaggggagatcatcgggacaactctccttttgatggacctggaggaaatcttgctcatgcttttcaaccaggcccaggtattggaggggatgctcattttgatgaagatgaaaggtggaccaacaatttcagagagtacaacttacatcgtgttgcagctcatgaactcggccattctcttggactctcccattctactgatatcggggctttgatgtaccctagctacaccttcagtggtgatgttcagctagctcaggatgacattgatggcatccaagccatatatggacgttcccaaaatcctgtccagcccatcggcccacaaaccccaaaagcgtgtgacagtaagctaacctttgatgctataactacgattcggggagaagtgatgttctttaaagacagattctacatgcgcacaaatcccttctacccggaagttgagctcaatttcatttctgttttctggccacaactgccaaatgggcttgaagctgcttacgaatttgccgacagagatgaagtccggtttttcaaagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtatgatgaatataaacgatctatggatccaggttatcccaaaatgatagcacatgactttcctggaattggccacaaagttgatgcagttttcatgaaagatggatttttctatttctttcatggaacaagacaatacaaatttgatcctaaaacgaagagaattttgactctccagaaagctaatagctggttcaactgcaggaaaaattgaacattactaatttgaatggaaaacacatggtgtgagtccaaagaaggtgttttcctgaagaactgtctattttctcagtcatttttaacctctagagtcactgatacacagaatataatcttatttatacctcagtttgcatatttttttactatttagaatgtagccctttttgtactgatataatttagttccacaaatggtgggtacaaaaagtcaagtttgtggcttatggattcatataggccagagttgcaaagatcttttccagagtatgcaactctgacgttgatcccagagagcagcttcagtgacaaacatatcctttcaagacagaaagagacaggagacatgagtctttgccggaggaaaagcagctcaagaacacatgtgcagtcactggtgtcaccctggataggcaagggataactcttctaacacaaaataagtgttttatgtttggaataaagtcaaccttgtttctactgtttt

SEQ ID NO: 151869 - DNA, 1758 bp, Homo sapiens
  Payload ID: 9891
  Gene Symbol: MMP10
  Gene Name: matrix metallopeptidase 10
  Uniprot ID: P09238
  ENST ID: ENST00000279441
  CDS Start-End: 38-1468
agaagcccagtagacaaagaaggtaagggcagtgagaatgatgcatcttgcattccttgtgctgttgtgtctgccagtctgctctgcctatcctctgagtggggcagcaaaagaggaggactccaacaaggatcttgcccagcaatacctagaaaagtactacaacctcgaaaaggatgtgaaacagtttagaagaaaggacagtaatctcattgttaaaaaaatccaaggaatgcagaagttccttgggttggaggtgacagggaagctagacactgacactctggaggtgatgcgcaagcccaggtgtggagttcctgacgttggtcacttcagctcctttcctggcatgccgaagtggaggaaaacccaccttacatacaggattgtgaattatacaccagatttgccaagagatgctgttgattctgccattgagaaagctctgaaagtctgggaagaggtgactccactcacattctccaggctgtatgaaggagaggctgatataatgatctcttttgcagttaaagaacatggagacttttactcttttgatggcccaggacacagtttggctcatgcctacccacctggacctgggctttatggagatattcactttgatgatgatgaaaaatggacagaagatgcatcaggcaccaatttattcctcgttgctgctcatgaacttggccactccctggggctctttcactcagccaacactgaagctttgatgtacccactctacaactcattcacagagctcgcccagttccgcctttcgcaagatgatgtgaatggcattcagtctctctacggacctccccctgcctctactgaggaacccctggtgcccacaaaatctgttccttcgggatctgagatgccagccaagtgtgatcctgctttgtccttcgatgccatcagcactctgaggggagaatatctgttctttaaagacagatatttttggcgaagatcccactggaaccctgaacctgaatttcatttgatttctgcattttggccctctcttccatcatatttggatgctgcatatgaagttaacagcagggacaccgtttttatttttaaaggaaatgagttctgggccatcagaggaaatgaggtacaagcaggttatccaagaggcatccataccctgggttttcctccaaccataaggaaaattgatgcagctgtttctgacaaggaaaagaagaaaacatacttctttgcagcggacaaatactggagatttgatgaaaatagccagtccatggagcaaggcttccctagactaatagctgatgactttccaggagttgagcctaaggttgatgctgtattacaggcatttggatttttctacttcttcagtggatcatcacagtttgagtttgaccccaatgccaggatggtgacacacatattaaagagtaacagctggttacattgctaggcgagatagggggaagacagatatgggtgtttttaataaatctaataattattcatctaatgtattatgagccaaaatggttaatttttcctgcatgttctgtgactgaagaagatgagccttgcagatatctgcatgtgtcatgaagaatgtttctggaattcttcacttgcttttgaattgcactgaacagaattaagaaatactcatgtgcaataggtgagagaatgtattttcatagatgtgttattacttcctcaataaaaagttttattttgggcctgttcctt

SEQ ID NO: 151870 - DNA, 581 bp, Homo sapiens
  Payload ID: 9891
  Gene Symbol: MMP10
  Gene Name: matrix metallopeptidase 10
  ENST ID: ENST00000539681
  CDS Start-End: 38-581
agaagcccagtagacaaagaaggtaagggcagtgagaatgatgcatcttgcattccttgtgctgttgtgtctgccagtctgctctgcctatcctctgagtggggcagcaaaagaggaggactccaacaaggatcttgcccagcaatacctagaaaagtactacaacctcgaaaaggatgtgaaacagtttagaagaaaggacagtaatctcattgttaaaaaaatccaaggaatgcagaagttccttgggttggaggtgacagggaagctagacactgacactctggaggtgatgcgcaagcccaggtgtggagttcctgacgttggtcacttcagctcctttcctggcatgccgaagtggaggaaaacccaccttacatacaggattgtgaattatacaccagatttgccaagagatgctgttgattctgccattgagaaagctctgaaagtctgggaagaggtgactccactcacattctccaggctgtatgaaggagaggctgatataatgatctcttttgcagttaaaggacacagtttggctcatgcctacccacctggacctgggctttatggag

SEQ ID NO: 151871 - DNA, 2291 bp, Homo sapiens
  Payload ID: 9892
  Gene Symbol: MMP11
  Gene Name: matrix metallopeptidase 11
  Uniprot ID: P24347
  ENST ID: ENST00000215743
  CDS Start-End: 53-1519
ataaggggcggcggcccggagcggcccagcaagcccagcagccccggggcggatggctccggccgcctggctccgcagcgcggccgcgcgcgccctcctgcccccgatgctgctgctgctgctccagccgccgccgctgctggcccgggctctgccgccggacgcccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttctttttttttttttaaactgaggattgtcattaaacacagttgttttcta

SEQ ID NO: 151872 - DNA, 2071 bp, Homo sapiens
  Payload ID: 9892
  Gene Symbol: MMP11
  Gene Name: matrix metallopeptidase 11
  ENST ID: ENST00000437086
  CDS Start-End: 23-1087
aagcccagcagccccggggcggatggctccggccgcctggctccgcagcgcggccgcgcgcgccctcctgcccccgatgctgctgctgctgctccagccgccgccgctgctggcccgggctctgccgccggacgcccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttctttttttttttttaaactgaggattgtcattaaacacagttgttttcta

SEQ ID NO: 151873 - DNA, 537 bp, Homo sapiens
  Payload ID: 9892
  Gene Symbol: MMP11
  Gene Name: matrix metallopeptidase 11
  ENST ID: ENST00000428253
  CDS Start-End: 26-367
agcaagcccagcagccccggggcggatggctccggccgcctggctccgcagcgcggccgcgcgcgccctcctgcccccgatgctgctgctgctgctccagccgccgccgctgctggcccgggctctgccgccggacgcccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggtaggggcctgggagcaggacactaggatgccacctgtgtgtccgtgggatccttcggttcccatggcagttggtgcaggagcaggtgcggcagacgatggcagaggccctaaaggtatggagcgatgtgacgccactcacctttactgaggtgcacgagggccgtgctgacat

SEQ ID NO: 151874 - DNA, 1165 bp, Homo sapiens
  Payload ID: 9892
  Gene Symbol: MMP11
  Gene Name: matrix metallopeptidase 11
  ENST ID: ENST00000434318
  CDS Start-End: 1-512
cagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagagctgggatttccatcctcaactggcagagatgagagcctggagcattgcagatgccagggacttcacaaatgaaggcacagcatgggaaacctgcgtgggttccagggcagtccagcctgcaggggcccagggagtggtcagtaggcatttgtcacagccaaatgccagtggaaggagcagccgcccaggcagccctctactgatgagagtaacctcacccgtgcactagtttacagagcattcactgccccagcttatcccaggcctcccgcttccctctgcgggtggggtgctgagcaggcattattggcctgcatgttttactgatgaggaaactgaggctgggagagtctgtggtaggggtcaagcaggtccacagtggcggggcatggcagtggtggctgggcaggtccttgcagccttccctctccggcaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctcta

SEQ ID NO: 151875 - DNA, 2291 bp, Homo sapiens; identical to SEQ ID NO: 151871
  Payload ID: 9892
  Gene Symbol: MMP11
  Gene Name: matrix metallopeptidase 11
  Uniprot ID: P24347
  ENST ID: ENST00000612388
  CDS Start-End: 53-1519

SEQ ID NO: 151876 - DNA, 1165 bp, Homo sapiens; identical to SEQ ID NO: 151874
  Payload ID: 9892
  Gene Symbol: MMP11
  Gene Name: matrix metallopeptidase 11
  ENST ID: ENST00000627283
  CDS Start-End: 1-512

SEQ ID NO: 151877 - DNA, 2071 bp, Homo sapiens; identical to SEQ ID NO: 151872
  Payload ID: 9892
  Gene Symbol: MMP11
  Gene Name: matrix metallopeptidase 11
  ENST ID: ENST00000629514
  CDS Start-End: 23-1087

SEQ ID NO: 151878 - DNA, 1874 bp, Homo sapiens
  Payload ID: 9893
  Gene Symbol: MMP12
  Gene Name: matrix metallopeptidase 12
  Uniprot ID: P39900
  ENST ID: ENST00000571244
  CDS Start-End: 98-1510
cagaacccggactaagggctatataaagaggaacagttcaggaacttaggctagaaaggaacacagtaaactgaattgatccgtttagaagtttacaatgaagtttcttctaatactgctcctgcaggccactgcttctggagctcttcccctgaacagctctacaagcctggaaaaaaataatgtgctatttggtgaaagatacttagaaaaattttatggccttgagataaacaaacttccagtgacaaaaatgaaatatagtggaaacttaatgaaggaaaaaatccaagaaatgcagcacttcttgggtctgaaagtgaccgggcaactggacacatctaccctggagatgatgcacgcacctcgatgtggagtccccgatgtccatcatttcagggaaatgccaggggggcccgtatggaggaaacattatatcacctacagaatcaataattacacacctgacatgaaccgtgaggatgttgactacgcaatccggaaagctttccaagtatggagtaatgttacccccttgaaattcagcaagattaacacaggcatggctgacattttggtggtttttgcccgtggagctcatggagacttccatgcttttgatggcaaaggtggaatcctagcccatgcttttggacctggatctggcattggaggggatgcacatttcgatgaggacgaattctggactacacattcaggaggcacaaacttgttcctcactgctgttcacgagattggccattccttaggtcttggccattctagtgatccaaaggccgtaatgttccccacctacaaatatgttgacatcaacacatttcgcctctctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcaatttaagaccagagccaaattatcccaagagcatacattcttttggttttcctaactttgtgaaaaaaattgatgcagctgtttttaacccacgtttttataggacctacttctttgtagataaccagtattggaggtatgatgaaaggagacagatgatggaccctggttatcccaaactgattaccaagaacttccaaggaatcgggcctaaaattgatgcagtcttctactctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaaggccaagagaattctatttgaagcatgctctgtaagttgcttcctaacatccttggactgagaaattatacttacttctggcataactaaaattaagtatatatattttggctcaaataaaattgaaaaaaaaa

SEQ ID NO: 151879 - DNA, 2716 bp, Homo sapiens
  Payload ID: 9894
  Gene Symbol: MMP13
  Gene Name: matrix metallopeptidase 13
  Uniprot ID: P45452
  ENST ID: ENST00000260302
  CDS Start-End: 30-1445
acaacagtccccaggcatcaccattcaagatgcatccaggggtcctggctgccttcctcttcttgagctggactcattgtcgggccctgccccttcccagtggtggtgatgaagatgatttgtctgaggaagacctccagtttgcagagcgctacctgagatcatactaccatcctacaaatctcgcgggaatcctgaaggagaatgcagcaagctccatgactgagaggctccgagaaatgcagtctttcttcggcttagaggtgactggcaaacttgacgataacaccttagatgtcatgaaaaagccaagatgcggggttcctgatgtgggtgaatacaatgttttccctcgaactcttaaatggtccaaaatgaatttaacctacagaattgtgaattacacccctgatatgactcattctgaagtcgaaaaggcattcaaaaaagccttcaaagtttggtccgatgtaactcctctgaattttaccagacttcacgatggcattgctgacatcatgatctcttttggaattaaggagcatggcgacttctacccatttgatgggccctctggcctgctggctcatgcttttcctcctgggccaaattatggaggagatgcccattttgatgatgatgaaacctggacaagtagttccaaaggctacaacttgtttcttgttgctgcgcatgagttcggccactccttaggtcttgaccactccaaggaccctggagcactcatgtttcctatctacacctacaccggcaaaagccactttatgcttcctgatgacgatgtacaagggatccagtctctctatggtccaggagatgaagaccccaaccctaaacatccaaaaacgccagacaaatgtgacccttccttatcccttgatgccattaccagtctccgaggagaaacaatgatctttaaagacagattcttctggcgcctgcatcctcagcaggttgatgcggagctgtttttaacgaaatcattttggccagaacttcccaaccgtattgatgctgcatatgagcacccttctcatgacctcatcttcatcttcagaggtagaaaattttgggctcttaatggttatgacattctggaaggttatcccaaaaaaatatctgaactgggtcttccaaaagaagttaagaagataagtgcagctgttcactttgaggatacaggcaagactctcctgttctcaggaaaccaggtctggagatatgatgatactaaccatattatggataaagactatccgagactaatagaagaagacttcccaggaattggtgataaagtagatgctgtctatgagaaaaatggttatatctattttttcaacggacccatacagtttgaatacagcatctggagtaaccgtattgttcgcgtcatgccagcaaattccattttgtggtgttaagtgtctttttaaaaattgttatttaaatcctgaagagcatttggggtaatacttccagaagtgcggggtaggggaagaagagctatcaggagaaagcttggttctgtgaacaagcttcagtaagttatctttgaatatgtagtatctatatgactatgcgtggctggaaccacattgaagaatgttagagtaatgaaatggaggatctctaaagagcatctgattcttgttgctgtacaaaagcaatggttgatgatacttcccacaccacaaatgggacacatggtctgtcaatgagagcataatttaaaaatatatttataaggaaattttacaagggcataaagtaaatacatgcatataatgaataaatcattcttactaaaaagtataaaatagtatgaaaatggaaatttgggagagccatacataaaagaaataaaccaaaggaaaatgtctgtaataatagactgtaacttccaaataaataattttcattttgcactgaggatattcagatgtatgtgcccttcttcacacagacactaacgaaatatcaaagtcattaaagacaggagacaaaagagcagtggtaagaatagtagatgtggcctttgaattctgtttaattttcacttttggcaatgactcaaagtctgctctcatataagacaaatattcctttgcatattataaaggataaagaaggatgatgtctttttattaaaatatttcaggttcttcagaagtcacacattacaaagttaaaattgttatcaaaatagtctaaggccatggcatccctttttcataaattatttgattatttaagactaaaagttgcattttaaccctattttacctagctaattatttaattgtccagtttgtcttggatatataggctattttctaaagacttgtatagcatgaaataaaatatatcttataaagtggaagtatgtatattaaaaaagagacatccaaatttttttttaaagcagtctactagattgtgatcccttgagatatggaaggatgcctttttttctctgcatttaaaaaaatcccccagcacttcccacagtgcctattgatacttggggagggtgcttggcacttattgaatatatgatcggccatcaagggaagaactattgtgctcagagacactgttgataaaaactcaggcaaagaaaatgaaatgcatatttgcaaagtgtattaggaagtgtttatgttgtttataataaaaatatattttcaacaga

SEQ ID NO: 151880 - DNA, 1470 bp, Homo sapiens
  Payload ID: 9894
  Gene Symbol: MMP13
  Gene Name: matrix metallopeptidase 13
  ENST ID: ENST00000340273
  CDS Start-End: 1-1470
atgcatccaggggtcctggctgccttcctcttcttgagctggactcattgtcgggccctgccccttcccagtggtggtgatgaagatgatttgtctgaggaagacctccagtttgcagagcgctacctgagatcatactaccatcctacaaatctcgcgggaatcctgaaggagaatgcagcaagctccatgactgagaggctccgagaaatgcagtctttcttcggcttagaggtgactggcaaacttgacgataacaccttagatgtcatgaaaaagccaagatgcggggttcctgatgtgggtgaatacaatgttttccctcgaactcttaaatggtccaaaatgaatttaacctacagaattgtgaattacacccctgatatgactcattctgaagtcgaaaaggcattcaaaaaagccttcaaagtttggtccgatgtaactcctctgaattttaccagacttcacgatggcattgctgacatcatgatctcttttggaattaaggagcatggcgacttctacccatttgatgggccctctggcctgctggctcatgcttttcctcctgggccaaattatggaggagatgcccattttgatgatgatgaaacctggacaagtagttccaaaggctacaacttgtttcttgttgctgcgcatgagttcggccactccttaggtcttgaccactccaaggaccctggagcactcatgtttcctatctacacctacaccggcaaaagccactttatgcttcctgatgacgatgtacaagggatccagtctctctatggtccaggagatgaagaccccaaccctaaacatccaaaaacgccagacaaatgtgacccttccttatcccttgatgccattaccagtctccgaggagaaacaatgatctttaaagacagattcttctggcgcctgcatcctcagcaggttgatgcggagctgtttttaacgaaatcattttggccagaacttcccaaccgtattgatgctgcatatgagcacccttctcatgacctcatcttcatcttcagaggtagaaaattttgggctcttaatggttatgacattctggaaggttatcccaaaaaaatatctgaactgggtcttccaaaagaagttaagaagataagtgcagctgttcactttgaggatacaggcaagactctcctgttctcaggaaaccaggtctggagatatgatgatactaaccatattatggataaagactatccgagactaatagaagaagacttcccaggaattggtgataaagtagatgctgtctatgagaaaaatgagtctcactctgtcacccaggctggagttcattgtcgcaatctgagctcgctgcaacctccgcctcctgggttcaagagattctcctgcctcagcctctggagtagctgggattacaggttatatctattttttcaacggacccatacagtttga

SEQ ID NO: 151881 - DNA, 1152 bp, Homo sapiens
  Payload ID: 9894
  Gene Symbol: MMP13
  Gene Name: matrix metallopeptidase 13
  ENST ID: ENST00000615555
  CDS Start-End: 1-1152
atgcatccaggggtcctggctgccttcctcttcttgagctggactcattgtcgggccctgccccttcccagtggtggtgatgaagatgatttgtctgaggaagacctccagtttgcagagcgctacctgagatcatactaccatcctacaaatctcgcgggaatcctgaaggagaatgcagcaagctccatgactgagaggctccgagaaatgcagtctttcttcggcttagaggtgactggcaaacttgacgataacaccttagatgtcatgaaaaagccaagatgcggggttcctgatgtgggtgaatacaatgttttccctcgaactcttaaatggtccaaaatgaatttaacctacagaattgtgaattacacccctgatatgactcattctgaagtcgaaaaggcattcaaaaaagccttcaaagtttggtccgatgtaactcctctgaattttaccagacttcacgatggcattgctgacatcatgatctcttttggaattaaggagcatggcgacttctacccatttgatgggccctctggcctgctggctcatgcttttcctcctgggccaaattatggaggagatgcccattttgatgatgatgaaacctggacaagtagttccaaaggctacaacttgtttcttgttgctgcgcatgagttcggccactccttaggtcttgaccactccaaggaccctggagcactcatgtttcctatctacacctacaccggcaaaagccactttatgcttcctgatgacgatgtacaagggatccagtctctctatggtccaggagatgaagaccccaaccctaaacatccaaaaacgccagacaaatgtgacccttccttatcccttgatgccattaccagtctccgaggagaaacaatgatctttaaagacagattcttctggcgcctgcatcctcagcaggttgatgcggagctgtttttaacgaaatcattttggccagaacttcccaaccgtattgatgctgcatatgagcacccttctcatgacctcatcttcatcttcagaggtagaaaattttgggctcttaatggttatgacattctggaaggttatcccaaaaaaatatctgaactgggtcttccaaaagaagttaacaagcttcagtaa

SEQ ID NO: 151882 - DNA, 3732 bp, Homo sapiens
  Payload ID: 9895
  Gene Symbol: MMP14
  Gene Name: matrix metallopeptidase 14 (membrane-inserted)
  Uniprot ID: P50281
  ENST ID: ENST00000311852
  CDS Start-End: 262-2010
accagaggagagagcgagagagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagacccccccgttgtctcctgctccccctgctcacgctcggcaccgcgctcgcctccctcggctcggcccaaagcagcagcttcagccccgaagcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcggagatctgcctctgcctcacctaccccagggaacttccaaggaaggagcctgagccactggggactaagtgggcagaagaaacccttggcagccctgtgcctctcgaatgttagccttggatggggctttcacagttagaagagctgaaaccaggggtgcagctgtcaggtagggtggggccggtgggagaggcccgggtcagagccctgggggtgagcctgaaggccacagagaaagaaccttgcccaaactcaggcagctggggctgaggcccaaaggcagaacagccagagggggcaggaggggaccaaaaaggaaaatgaggacgtgcagcagcattggaaggctggggccgggcaggccaggccaagccaagcagggggccacagggtgggctgtggagctctcaggaagggccctgaggaaggcacacttgctcctgttggtccctgtccttgctgcccaggcagcgtggaggggaagggtagggcagccagagaaaggagcagagaaggcacacaaacgaggaatgaggggcttcacgagaggccacagggcctggctggccacgctgtcccggcctgctcaccatctcagtgaggggcaggagctggggctcgcttaggctgggtccacgcttccctggtgccagcacccctcaagcctgtctcaccagtggcctgccctctcgctcccccacccagcccacccattgaagtctccttgggccaccaaaggtggtggccatggtaccggggacttgggagagtgagacccagtggagggagcaagaggagagggatgtcgggggggtggggcacggggtaggggaaatggggtgaacggtgctggcagttcggctagatttctgtcttgtttgtttttttgttttgtttaatgtatatttttattataattattatatatgaattccattcaaatcgttcctttttgttaacaaggggcatggggaggggtgggggtgggggggcagaggcgtctgaccccaggaacctgcagggcggggctgggtcggtgccctctaaggacaattttgaccttgttcaacctttccacaaagaataaattgtgtttcacattc

SEQ ID NO: 151883 - DNA, 582 bp, Homo sapiens
  Payload ID: 9895
  Gene Symbol: MMP14
  Gene Name: matrix metallopeptidase 14 (membrane-inserted)
  ENST ID: ENST00000548761
  CDS Start-End: 1-582
atgcgcgagagtttgttgtttcttcgacttcccagctctccagcgctctcccgccggcgcgccctccgatgggcgcttcggcctccccgggtggcccaggccttcagcggacgagtctgcggccaggcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgac

SEQ ID NO: 151884 - DNA, 412 bp, Homo sapiens
  Payload ID: 9895
  Gene Symbol: MMP14
  Gene Name: matrix metallopeptidase 14 (membrane-inserted)
  ENST ID: ENST00000547279
  CDS Start-End: 199-412
aaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagacccccccgttgtctcctgctccccctgctcacgctcggcaccgcgctcgcctccctcggctcggcccaaagcagcagcttcagccccgaatccttggaagaactttacaactggggcgaactcccccttccccgattcccttgggctctgctctcagctctggaaccgcctgataaacatttggactccgctcaaa

SEQ ID NO: 151885 - DNA, 4250 bp, Homo sapiens
  Payload ID: 9896
  Gene Symbol: MMP15
  Gene Name: matrix metallopeptidase 15 (membrane-inserted)
  Uniprot ID: P51511
  ENST ID: ENST00000219271
  CDS Start-End: 786-2795
cgcggggtgggctggagaggtttcctgccgtctgggaagcgtaaacggaccgcccacctgtcgggcctcggccgcccgcacctgcttgtgagaagcctgcggctggggcaccgcccccggtccccgcccgggtccgcgcattgggagcacactggccctttaagagcgcggcggccgcggcgcgcggggaggagggctgggagcgcccggagccgcgctgaactcgccggggacgtcgggcgcccgctccttggctggctcgcttgctctctcgctcgctctctcgggtcggctccctgcgcctcctcccgggactgcttggggacccgggcccggtcgggcgcggcggcgagcagaatccccgtgcaggaggcgcgcgctccgggcagcgcccggccccgggcatggacagagggagctgggcgcgcagggagcgccgcgggaccgggcggccggagcgctgagccagacaaaggctccggagttgcgcttgctctcgggagccgggccccaggcgctgggcgccgaggctgcggaacctcgccgggggcagctccggtcggccccctttcccgccggctggttccgagctcccggacctgccctgcccgcttctcctcgggcttgggaatttgccgaggcgacctaggcggctccggcggggaccgggagcccgaggtccgcggcgcgcctgccgggccaggagccagggagcgtcgcaagtttccaaggcgcgtgcgaggatccggcgtgcagtgttccgagctgggctgggcgccgagagcatgggcagcgacccgagcgcgcccggacggccgggctggacgggcagcctcctcggcgaccgggaggaggcggcgcggccgcgactgctgccgctgctcctggtgcttctgggctgcctgggccttggcgtagcggccgaagacgcggaggtccatgccgagaactggctgcggctttatggctacctgcctcagcccagccgccatatgtccaccatgcgttccgcccagatcttggcctcggcccttgcagagatgcagcgcttctacgggatcccagtcaccggtgtgctcgacgaagagaccaaggagtggatgaagcggccccgctgtggggtgccagaccagttcggggtacgagtgaaagccaacctgcggcggcgtcggaagcgctacgccctcaccgggaggaagtggaacaaccaccatctgacctttagcatccagaactacacggagaagttgggctggtaccactcgatggaggcggtgcgcagggccttccgcgtgtgggagcaggccacgcccctggtcttccaggaggtgccctatgaggacatccggctgcggcgacagaaggaggccgacatcatggtactctttgcctctggcttccacggcgacagctcgccgtttgatggcaccggtggctttctggcccacgcctatttccctggccccggcctaggcggggacacccattttgacgcagatgagccctggaccttctccagcactgacctgcatggaaacaacctcttcctggtggcagtgcatgagctgggccacgcgctggggctggagcactccagcaaccccaatgccatcatggcgccgttctaccagtggaaggacgttgacaacttcaagctgcccgaggacgatctccgtggcatccagcagctctacggtaccccagacggtcagccacagcctacccagcctctccccactgtgacgccacggcggccaggccggcctgaccaccggccgccccggcctccccagccaccacccccaggtgggaagccagagcggcccccaaagccgggccccccagtccagccccgagccacagagcggcccgaccagtatggccccaacatctgcgacggggactttgacacagtggccatgcttcgcggggagatgttcgtgttcaagggccgctggttctggcgagtccggcacaaccgcgtcctggacaactatcccatgcccatcgggcacttctggcgtggtctgcccggtgacatcagtgctgcctacgagcgccaagacggtcgttttgtctttttcaaaggtgaccgctactggctctttcgagaagcgaacctggagcccggctacccacagccgctgaccagctatggcctgggcatcccctatgaccgcattgacacggccatctggtgggagcccacaggccacaccttcttcttccaagaggacaggtactggcgcttcaacgaggagacacagcgtggagaccctgggtaccccaagcccatcagtgtctggcaggggatccctgcctcccctaaaggggccttcctgagcaatgacgcagcctacacctacttctacaagggcaccaaatactggaaattcgacaatgagcgcctgcggatggagcccggctaccccaagtccatcctgcgggacttcatgggctgccaggagcacgtggagccaggcccccgatggcccgacgtggcccggccgcccttcaacccccacgggggtgcagagcccggggcggacagcgcagagggcgacgtgggggatggggatggggactttggggccggggtcaacaaggacgggggcagccgcgtggtggtgcagatggaggaggtggcacggacggtgaacgtggtgatggtgctggtgccactgctgctgctgctctgcgtcctgggcctcacctacgcgctggtgcagatgcagcgcaagggtgcgccacgtgtcctgctttactgcaagcgctcgctgcaggagtgggtctgaccacccagcgctcctgctaacggtgctcagggggcgcctgtggttctgagatggctcccaggggctccctccgcccccaggtaggggcccctctcagccctcacacaccctgtctgccccgccctcattatttatgtccaggtgtttgttttgttttgtttttggcaccttacttgaccatttgtttctgtttccccgactggggcagggtgtttagaattttctaaatgtagttctgctccagacagggaattaggcccccatcatcctctggcttggccacagccaggggagcagaggggcagaggcccacattggaagagcagcacctcctcagcctgaaccccagggctgtaactgccaggctctctttgcccagttggagactgtctggcccccctggtcccctccttcccaagtgagtctctctgggccttaggaagagccttccacccaggggcagccccaggccaaaggggacctggaagggaggtgggccgtggcccttgagtccccattgaggcttggttccttcccaatccagtggacttcgcagtccacttctgacagcctcagtgaccctggctccttgtgccagagaacccagcccacccccggcagcagcccccagctcccacctccccttgggcccacacctccttccctctctggagaaagggccctgggcctgcctcaccacggaccaaagggagtctgccagggcccctctccccagggaagcagcagcctcgcccctggcagagatgcctccctgagctagaaccctctgttccttccctgtgcctcctccctccctctccgactcacaccactagcctcaggggtctgagctccagctcctttgggcttcagctgccagtgtcctgagccccagggagagggggctggtgggtgcctaggcctgggcagtggatggccgtgaatgggtgcccacagtgtcaggcactgggcatgaggggttcctcccctccagctccctgtgcccccagggtcctgggaggagagacactggtggggataggccagccgcgcatcagactgtgaaccccacgaaggagcccattgtggcctaagaggctgccctcctgtgctcagccctgaggacagatgcctccttcctcttttccttcccaaagcaagcaagaggccgtggctgctgtgggaaatggtactgtacagctggctctacttccccatggccctgagcgagtggagtctgccacccaggatccccaaggcacttgagggggaaggattctgctggcctctgcgagtggtttcttgtgcactggcaccaagtgcgggtccggcagcttctgccccctgcagaaccggagagccagctaaggggtggggctgcgggggttccgtgtccacccccatacatttatttctgtaaataatgtgcactgaataaattgtacagccggcaaa

SEQ ID NO: 151886 - DNA, 349 bp, Homo sapiens
  Payload ID: 9896
  Gene Symbol: MMP15
  Gene Name: matrix metallopeptidase 15 (membrane-inserted)
  ENST ID: ENST00000570065
  CDS Start-End: 1-293
ccagcactgacctgcatggaaacaacctcttcctggtggcagtgcatgagctgggccacgcgctggggctggagcactccagcaaccccaatgccatcatggcgccgttctaccagtggaaggacgttgacaacttcaagctgcccgaggacgatctccgtggcatccagcagctctacggtgcgtgggctgtgaccagcgggctctgcatgccgctctcaagtccctggccaatgaggagtaggcattgctgccatccccattttgtagatgaggaacccaaggctcagtgaggattagtgacttgcccacatcatttggggaataaatggtggtactggaaatgaaa

SEQ ID NO: 151887 - DNA, 11558 bp, Homo sapiens
  Payload ID: 9897
  Gene Symbol: MMP16
  Gene Name: matrix metallopeptidase 16 (membrane-inserted)
  Uniprot ID: P51512
  ENST ID: ENST00000286614
  CDS Start-End: 283-2106
tctttgagccggaaccgccggtgaacttaggcgccacgttcccggtgactgaccccggaggatggtgaacaggaactactgctgaccctgtcttcgccgctgcctctcgggggctgccgagcgcggggcccctgtctcctccccttgcccggctgtgggtgaacctgcaggctccttacccacccggaggacttttttttgaaaggaaacgagggagggagggagagggagagagggagaaaacgaaggggagctcgtccatccattgaagcacagttcactatgatcttactcacattcagcactggaagacggttggatttcgtgcatcattcgggggtgtttttcttgcaaaccttgctttggattttatgtgctacagtctgcggaacggagcagtatttcaatgtggaggtttggttacaaaagtacggctaccttccaccgactgaccccagaatgtcagtgctgcgctctgcagagaccatgcagtctgccctagctgccatgcagcagttctatggcattaacatgacaggaaaagtggacagaaacacaattgactggatgaagaagccccgatgcggtgtacctgaccagacaagaggtagctccaaatttcatattcgtcgaaagcgatatgcattgacaggacagaaatggcagcacaagcacatcacttacagtataaagaacgtaactccaaaagtaggagaccctgagactcgtaaagctattcgccgtgcctttgatgtgtggcagaatgtaactcctctgacatttgaagaagttccctacagtgaattagaaaatggcaaacgtgatgtggatataaccattatttttgcatctggtttccatggggacagctctccctttgatggagagggaggatttttggcacatgcctacttccctggaccaggaattggaggagatacccattttgactcagatgagccatggacactaggaaatcctaatcatgatggaaatgacttatttcttgtagcagtccatgaactgggacatgctctgggattggagcattccaatgaccccactgccatcatggctccattttaccagtacatggaaacagacaacttcaaactacctaatgatgatttacagggcatccagaagatatatggtccacctgacaagattcctccacctacaagacctctaccgacagtgcccccacaccgctctattcctccggctgacccaaggaaaaatgacaggccaaaacctcctcggcctccaaccggcagaccctcctatcccggagccaaacccaacatctgtgatgggaactttaacactctagctattcttcgtcgtgagatgtttgttttcaaggaccagtggttttggcgagtgagaaacaacagggtgatggatggatacccaatgcaaattacttacttctggcggggcttgcctcctagtatcgatgcagtttatgaaaatagcgacgggaattttgtgttctttaaaggtaacaaatattgggtgttcaaggatacaactcttcaacctggttaccctcatgacttgataacccttggaagtggaattccccctcatggtattgattcagccatttggtgggaggacgtcgggaaaacctatttcttcaagggagacagatattggagatatagtgaagaaatgaaaacaatggaccctggctatcccaagccaatcacagtctggaaagggatccctgaatctcctcagggagcatttgtacacaaagaaaatggctttacgtatttctacaaaggaaaggagtattggaaattcaacaaccagatactcaaggtagaacctggatatccaagatccatcctcaaggattttatgggctgtgatggaccaacagacagagttaaagaaggacacagcccaccagatgatgtagacattgtcatcaaactggacaacacagccagcactgtgaaagccatagctattgtcattccctgcatcttggccttatgcctccttgtattggtttacactgtgttccagttcaagaggaaaggaacaccccgccacatactgtactgtaaacgctctatgcaagagtgggtgtgatgtagggttttttcttctttctttcttttgcaggagtttgtggtaacttgagattcaagacaagagctgttatgctgtttcctagctaggagcaggcttgtggcagcctgattcggggctgacctttcaaacccagagggttgctggtcctgcacatgagtggaaatacactcatggggaagcttccatgatgcacagtatctgctgttcttcagtcctttgtctttctttgtcattcagttctaggcctttcctctgcacgctcaatgcccagtaaaatttcaggattaactaaagaagaggagaaaaagaagaaaagattcttcttaaaagtttctaatgttattttccttctgaagtctgagcccatttctggggggagaaaaaaaaagcaaatcagaaaacccacggtttttctttttttctttttttctttttttctttttttgctttaaaacaaagggaaaaaagagtttaaacaaaaaacccacaattgaacttccaggaaagtgtgaagacccaaaacagctttgtctccaaagaagatagctctctgactgctttggatagtctcctacgcaccattttgtcaggtgggagatttggaatacacatgcaggacgttagactgttgggacagccattttccaacaaccaaggggccaaaatatctgcaatatagtaacagccttaataatacatccatttttcgttttatacagctgttctcagctatgtcctcagtgtttcatcgcatttatattcatagctattttcaaacacgaccttttaattgtttttgaagtatttctaaaccccttctttccaccttactcctccatcattgtgataatcttcccaagttgtattaggccattgccccaggccttccatgggtctgtcaggaatattcgttacaaagcagagcaagaagcagtatgtctctgaagtggattacagtggcagttattttacaaggatttgtgacactagtaacatacccgtgtaaccctttgagaactatcagaccagctttcagagtcttaggattgtcggtcttgcgatctgataaattatagaactgggcaatggtaaaaacagtcacaagttcaagaagttcaggtttttaaaacagatatcctataatgtcatataatttttaaatgatttacaagactacataaatgtgtttataacaaacagaaatgatgttacttgccaaaatttttctggcaaataaaaaaggtattttattaagattctcataaatctgaaattttatttgaaaaactgataatagcctaagtcttcttttcttttttttaggcatactgaatttctgttttaaaatccattgcatgaaaattcaatttgccttggtatatgcagttagcattgccattttaaaaatgaattaaaacggtgactctgaagttgcatgaatatcctccagtgcattacctattgcatgtccaccatagttctcaaagggttagtgtggcttctggcatttagccgtccatttgatcactgacagagccaagagaccaccaaagcatttcattgttgagtgtaatttgtcctaacagcagtattgtcattttcatgtgacctgcagagcaggtttgtatcaatatttttttcctagagaaaagtcagcaactgacagacctctttattgatttttaggagctgcttcttgcagtgaaaggctttacagccactgggctgtgaacttattagagatggtcagaatgaatgcaccccatgagtcagacattggctttgtgtgaaagccagctttgaggggattagcttttgaaacaatgaacagcttgccttgaacttgattattgatctattgactgtcattaacaacaacttaaacattgtcttctgtgaaaattttccttgaagagtcctgttctatgtctttgccctttgacctttaacttgcaaactggcacaaactgaaggaaatctggtgttgcttctccattggattagttgttctctaaaacctagtaagcatgagctgtttccttagagtggagagagtggtgatggcagatctgcagatggacactttgctctttacatgcacactctgaaaatgccctataggtagaagtgaattttaatttcattttaatataatttcaagtctaaattcatcattttagtacaaattacaaaaactataggaaaaaaaaaacctcaaatacttgaatggccagtgtggcttttatataaagcaggaattttatactagtaaaaatttcttactcatttgctaatacacatttccagatgatttttaatgagtgtaggtatacattcttatttggaaatggatagtttggctgccttgaatttatatttatactcaacgtagcatgaaaattagaatgccttttggttaaactacatgtttatgatttggttggggaaaatattttataattgtgggtggcatgctgcaaagccttgcagattgttatttcttacaacctgagcgtatatagtatgagcctaagaaaaaagaagagtaagaaaagaagaatggctttacagtaaaatatcatacaatgcagacaatattttaagaggatattggagattatgtacgcaagggccaagaaagcaagaaatgagaaccagagtcagccctgtagctttacttcagtgcttccattctagatgatgctgatattataaagagttagtcactgctgctaagcatggaggactatatacataagctcgtttatacagtgtttgcttgtgggagggtttaatccttttagggccttgatgtcaagaaaaaaataactggaaactatattttgctaaagatagaaatgaggaactgtgtcattttgggacatgtgcaaatcattgaggaactccatcaccctgcattgaaaattgatttttttttcctctaaaatgagaaagaaactgaataagcaatctgttgcctctttactcattcatcacaatatcctgattcgtcataaggctatcagtatataagggctagaaaataatcatagcattaagaaggaaggagtctatcattatgcttgaattctggcaaatgtcatgaataagggttgggtcatatttactttaatatgagacaagatttatgtgataagcaaaggcatataaggctgctcttttgaacagaacatttcagttatcaggctgtactattacaagagataagaagacaataaggacaatgtaatcacaaacagtgggattccatttgtttattgtacaccagctactttgtgggtatggttcctgactcctcttctacatgaggtttgggaaaaaagtctcaaaccaaatggaacagtgaaagggaaagtaattcatctagcacataagaatagtgattcaaaaccaatgcagaataaatttccatgggtcaataacataaggtgtcagttcagtgttactagagatatgcaaggcataaaatattttcatcaccccatcactaataacatgaaaagctcagacataggatttcccaaattgaaatgaaaacacattcatgcctgcaaaaataattctccttctgcttcatttctcattactttatctaatataaacacaaatgtaaacaaggtaatggtcttcatgtaaaatgaccatatagttaagaattttagtaaaatattgttgttctgtgtattattaaacaaatgcaatgaagtattaaaatagctgatcagtttgaatttcctgtaaagcagtaattccgcatcagaattgtagataaggttgtgaatttattgactcatttcagaacagtgtctgttgacatggcagtcagagcaggtgaatacagatgctctttctgattgcaaaggttatagagctaaattagacagcattatgtgatactagcaaagacaacttctgttataaatcagagggcaaggcttttctgaatcgatgtgataaattactaagtaatgattaccaaaaataattactaagtaataaaagatacagactggtttactgaaataagcaagtgttacatttaataattacctataatctttttttgttaacacataagcaagtgttacctttaataattacctataatctttttttgttaacacataatttggccatttcatatactgtgtacctattttcattccctctctgtgggtcattaaaaaacacaatgtggtggataagaacattgtccaaacttcactgctagttccaatacatagatgatggtgtgtaaactggattgtaggggtagtcatatttgcaagttctacatgttatgctaatatatctagtatggtacacatacacgcccacactttgtggatcttacagtggaataaatagtgtgtccatattaactaaactcaaagtgctatctgaagaggaatggatgttataagcagacagacagactgagttaaactgagtcatgaaaaaatatatattttaaagtttttggaatcatttccagaaactaataaagggaattatttactggtagtattgagtctgtgagattgtagtatatactgaaacaatcttctggatggtggtaaggtcttttttagcaaacacagtaaagagcttatttcatttctgatgctttcaagggcatattccaaagtatcacagatgtcaaatagaatatgctatataaaccaaaaatgtgcatttcagatgacctattacagcaatctcagccaatatgtaatatcacaaaatgtgtcaagtcaatcatataagaggatctaatcattcggctgtatttcatgtaccttcatgttgttgatatattgtgaccacaggaaataggtgccagagcatatgcagttaagttacaggctccacgttgcctaggagggaatcataactacatcagaaaatttttaacagttatatcttaaaaattagaattttatgtaataaataaagcggcaaccaggaatagcaacgcaacaaatatgaaagctaattattatatttagctttcatatttatataatatgatggaaatggaggaggaaaaatgagtcttttgttaaatataaagacaaactataacactccttgataatacaactggaaattttactttagcaagcataaaatagtggaggaaaaaaatccaacttcaagctctttgcactagtgatgattatgtgatatatcaatgtaatatttagccagtggtcattagatgttactgtgcttaaacacatctgatactcatgcattgccttacaggctaaaaatgtaagaggtaggtgttcagtaacctcaagttggaaagatatataatgttagaatcccctgagacaagccatttccctgaaatagaaatttacctcaatactcatgtaatctaagacacttggcgtagtagcaaagaagttgccttcatgttctagtctcatctaattgtgacctttgtctttcatgtacttctgaaatcattttccactttttccactggtgtgattttgaaacaattctgaaatatttcaggtaagattaataacatccaattacaaatatatgtttcaatattttatacgtatgtctactttgaaagttaaaccaatagtatagaaagcctaagaatgaacactgattggacatactcacagaaattaagggaaaaacacatattgtaaaattcctgtcaatgtttgagtagaatacagaagtacatagcagtcttcaatttttaaacacaattatgggcttataactggacgtgacatgcatcatttattagaacaatattatttatttatactaagtaaggatataagatcacagaagcttagtgttataacggagacttcacagacattcataactaatgttttctaaggcaaataagggcataaaccagaactcatggtcagtgcagagtaagtataaaaagttatgtatgaaagacatttatttatagagatttctgaggattctatgccttttcaacttaaagatgagtgtgtcttagaatttgttttatgcatcattggactggggatgatattcaaatgtgcactcagcgtgtcctcacattaaagggcacattgaacagtataggaaaatacatcataaactagaatgttgtacagattcatataactttcccatgtgctctgctgtagagctgaatttatatgcccttaaaaagggataagaatcaattaaatataaatacggaaatatacttatgttaggtcacttagcttcagagcaagatgtcattaacctttatttcacagagaaaaactggaagaaaagaatggtgaacaagaataaaatgataaactttttggcttatagagatgtttcttgggaattttttccacttgtttttatacatgaaaaaaatatcagtcacaatacagacatttctgtagtatttggtctgtgggtaaactggatcccaggcagaatactttttgacacaggcctttttatacatgctttatatatgatgaagctttggtgagatgtgactgcatggtaggatgcattttcctaggataggatatggtgctgcttgtacttgccaccttttatatgaatgtatgtcgctacattggcctgtcttgccaagacatggttgaatgaagcctggtgtgagctgtctatttgaaaagtcactaggatgcatgtttcatttgccgttacataatgccaatttgaacctgtttcctctatatattaacaatccaattgttaagataaaatatactttgcttgaatgaatgattttggtagtaatatgagcgttatccttaaatcaatgttacaatttttgctattactgaaataccgtcacagaggccacattattggctgtctataccattgcctgagtaaaattaggtttttaggtctttttggcatttacttcttttacagctgatgtggaatcaattattcctttatatgttcataagtacaaaatttcactatcttaattacttccaaacaaacaatttccaagcaagggtatgtgtgcctggtttttctgctcctccaattctaagatcgttatttgtttgccttctgtttctcacccaaaaatacagatggttgggaaagatacatcttattgagttgtcctatgcagtctctgtctatatttgcatttctttctattcctatcttgccttttttttttttttttacacagatttggttttcccttccctttgtgaaaaccagaattgagcagcattgtacatcagagatggtacccaggaaatgtctttgttcctcagtatttttcgtcaaaacttccatgcaaagacagtcccagcaaagttgacatacatcccaacctctctcattggcttttctaactttttatagagctattcccctgagaaaagtgaaatgctgagtatgatgggtattgcctgttgataggatagctaaggaaatttgcttttggagaatgtatcttaaataattatacaggaaagtagtcacagtatagtgttctgtttaaggtacatcatgggtacataaatgcctaaaaccttcatcctttggtctatttctctgtaagtgtaaattacatatatattagaaagagagatagaatcaaagaattaggggtgttacagaggcagctttttgctgccttggttttgactgtatcagcatttctattgcagacctctattttcaggggttttagagactcgaccataaaaatttgtttcaggcttaaaagttttgaaagatttttttaggtatctgattttaaacaaatagatcttgtttttatattataggagggaaataaatggagtttactagttcaattttgcgctaatataacttttaataaacttaactttttaaacaaaaacataaaatctaattagttcatagttggttgatgcttttttaaaagaatcaattattgaccttgagaaacttgcctgcttcatcagtatagtaacctatctttaagatattttaaaacgtgtatacctttattaacattatcttgattccagcggtggatcagtatgataatgcagatttatgacatccatataagctatctggtaatatagatttaggaatatatagtatatatgatacatatatatatatatatttactagatagattaaggagaaaaagctcccataaacttagtttgtcaaataaataccatatatttaaaaaatgcacagacatttatcattcagagtcagaatgagattcaagtaattgcaaagggaagttgtctcttgggtaaacaatacacattttatagcttcttgtgaaactaattttttcctttctatattgtggttatgggaaagtaaaagaattaaaattaatacagactttatttaaataacattaaactgtgaagcagagagaaacgccaggaaattaaatatttaggccattatcttgtggttgtctgacaatacttcacctttcttttaattccccatgatgttttcaattatggagagagtattaaaatctagatttaagtttctgcattgttctcattacactcaacactatttcattaagttcttgataatatgtagtcttctgtgtgcaaggaaagaaataaataacacatttatttgctgaatgagttttaaggtgtgcaagttgtagtgatgtttttcccacacaggattctatacacttataccatcttaaatctggcattttttttttcagatagcttctactgacaaacacaaagcttgtttgtgtgcaaatataaggctaaataaatggtgctaaagtgtattatgactgtcagataaaatcaggcaaaattttgtggtgcttaaattaattttttcattgattttattgatcagtgcattgaacagtgtttattattcacaagttgtcttttattagtaaatcaaggcctcatagcacattgttaaataaagtggttgactagtctatgtaacagctcaccaagctactatctcttttaactccttataatgttgcgtcattaaaggtcaaggggtcatgctattaatctcattgctatagaccattaacatgactgaacttttccacaaagtacttatgtttacaatgctataaccctttgactgctgcggcaacctttaaccacacaaatgtcacaagctagaatcatcagcatggttcttgccatggcaatcaaagagttaagggctgtgcagtgatttgttttgtatttattaatttatatttattttgtttccattcaaggaggggattaggggtggggcagtttttgtctgctgtaagtgtcttaacctagggaagggttaaatggctttttatactattgcatcttctgtatttaccatcaattcattgtgttgtaattaaaagaaactgtcaataaataagagaacagaaaaatg

SEQ ID NO: 151888 - DNA, 551 bp, Homo sapiens
  Payload ID: 9897
  Gene Symbol: MMP16
  Gene Name: matrix metallopeptidase 16 (membrane-inserted)
  ENST ID: ENST00000522726
  CDS Start-End: 46-551
aagaaagaatggagccgcccaagttcctgggtgcctgcctcggggatgcgggatgggagatactgtcgaagagctgtgctcaaaccagggcccttgtcgcgggctggatacctccgcactggaagacggttggatttcgtgcatcattcgggggtgtttttcttgcaaaccttgctttggattttatgtgctacagtctgcggaacggagcagtatttcaatgtggaggtttggttacaaaagtacggctaccttccaccgactgaccccagaatgtcagtgctgcgctctgcagagaccatgcagtctgccctagctgccatgcagcagttctatggcattaacatgacaggaaaagtggacagaaacacaattgactggatgaagaagccccgatgcggtgtacctgaccagacaagaggtagctccaaatttcatattcgtcgaaagcgatatgcattgacaggacagaaatggcagcacaagcacatcacttacagtataaagaacgtaactccaaaagtaggagaccctgagactcgtaaagctat

SEQ ID NO: 151889 - DNA, 2411 bp, Homo sapiens
  Payload ID: 9898
  Gene Symbol: MMP17
  Gene Name: matrix metallopeptidase 17 (membrane-inserted)
  Uniprot ID: Q9ULZ9
  ENST ID: ENST00000360564
  CDS Start-End: 103-1914
agtccggcgggggcgccgcggagagcggagggcgccgggctgcggaacgcgaagcggagggcgcgggaccctgcacgccgcccgcgggcccatgtgagcgccatgcggcgccgcgcagcccggggacccggcccgccgcccccagggcccggactctcgcggctgccgctgccgctgctgctgctgctggcgctggggacccgcgggggctgcgccgcgcccgcacccgcgccgcgcgccgaggacctcagcctgggagtggagtggctaagcaggttcggttacctgcccccggctgaccccacaacagggcagctgcagacgcaagaggagctgtctaaggccatcacagccatgcagcagtttggtggcctggaggccaccggcatcctggacgaggccaccctggccctgatgaaaaccccacgctgctccctgccagacctccctgtcctgacccaggctcgcaggagacgccaggctccagcccccaccaagtggaacaagaggaacctgtcgtggagggtccggacgttcccacgggactcaccactggggcacgacacggtgcgtgcactcatgtactacgccctcaaggtctggagcgacattgcgcccctgaacttccacgaggtggcgggcagcgccgccgacatccagatcgacttctccaaggccgaccataacgacggctaccccttcgacggccccggcggcaccgtggcccacgccttcttccccggccaccaccacaccgccggggacacccactttgacgatgacgaggcctggaccttccgctcctcggatgcccacgggatggacctgtttgcagtggctgtccacgagtttggccacgccattgggttaagccatgtggccgctgcacactccatcatgcggccgtactaccagggcccggtgggtgacccgctgcgctacgggctcccctacgaggacaaggtgcgcgtctggcagctgtacggtgtgcgggagtctgtgtctcccacggcgcagcccgaggagcctcccctgctgccggagcccccagacaaccggtccagcgccccgcccaggaaggacgtgccccacagatgcagcactcactttgacgcggtggcccagatccggggtgaagctttcttcttcaaaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggagacaggtactgggtgttcaaggacaataacgtagaggaaggatacccgcgccccgtctccgacttcagcctcccgcctggcggcatcgacgctgccttctcctgggcccacaatgacaggacttatttctttaaggaccagctgtactggcgctacgatgaccacacgaggcacatggaccccggctaccccgcccagagccccctgtggaggggtgtccccagcacgctggacgacgccatgcgctggtccgacggtgcctcctacttcttccgtggccaggagtactggaaagtgctggatggcgagctggaggtggcacccgggtacccacagtccacggcccgggactggctggtgtgtggagactcacaggccgatggatctgtggctgcgggcgtggacgcggcagaggggccccgcgcccctccaggacaacatgaccagagccgctcggaggacggttacgaggtctgctcatgcacctctggggcatcctctcccccgggggccccaggcccactggtggctgccaccatgctgctgctgctgccgccactgtcaccaggcgccctgtggacagcggcccaggccctgacgctatgacacacagcgcgagcccatgagaggacagaggcggtgggacagcctggccacagagggcaaggactgtgccggagtccctgggggaggtgctggcgcgggatgaggacgggccaccctggcaccggaaggccagcagagggcactgtccgccagggctgggcaggctcaggtggcaaggacggagctgtcccctagtgagggactgtgttgactgacgagccgaggggtggccgctccagaagggtgcccagtcaggccgcaccgccgccagcctcctccggccctggagggagcatctcgggctgggggcccacccctctctgtgccggcgccaccaaccccacccacactgctgcctggtgctcccgccggcccacagggcctccgtccccaggtccccagtggggcagccctccccacagacgagccccccacatggtgccgcggcacgtcccccctgtgacgcgttccagaccaacatgacctctccctgcttt

SEQ ID NO: 151890 - DNA, 654 bp, Homo sapiens
  Payload ID: 9898
  Gene Symbol: MMP17
  Gene Name: matrix metallopeptidase 17 (membrane-inserted)
  ENST ID: ENST00000542648
  CDS Start-End: 300-654
cgttttaatttgcctttagcagacctctaggcaaggataggggctccacacaaggatgcctgtcccatgccgctcaggtcaggggctctgccgcaggatgccctgtcccgcgctgcccaggccccgcctcccagcccacctggctctctccctgcaggcccaggaaggacgtgccccacagatgcagcactcactttgacgcggtggcccagatccggggtgaagctttcttcttcaaaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggagacaggtactgggtgttcaaggacaataacgtagaggaaggatacccgcgccccgtctccgacttcagcctcccgcctggcggcatcgacgctgccttctcctgggcccacaatgacaggacttatttctttaaggaccagctgtactggcgctacgatgaccacacgaggcacatggaccccggctaccccgcccagagccccctgtggaggggtgtccccagcacgctggacgacgccatgcgctggtccgacggtg

SEQ ID NO: 151891 - DNA, 2301 bp, Homo sapiens
  Payload ID: 9898
  Gene Symbol: MMP17
  Gene Name: matrix metallopeptidase 17 (membrane-inserted)
  Uniprot ID: Q9ULZ9
  ENST ID: ENST00000535291
  CDS Start-End: 233-1792
aagagacaagaggtgccttgtgggcagatagggggctgggagggggcctgcccggaagcagtggtggcccgtggcaggcttctcactgggtaggaccgggccctctgttgcaccccctcaccctgctctctgccctcaggagtggctaagcaggttcggttacctgcccccggctgaccccacaacagggcagctgcagacgcaagaggagctgtctaaggccatcacagccatgcagcagtttggtggcctggaggccaccggcatcctggacgaggccaccctggccctgatgaaaaccccacgctgctccctgccagacctccctgtcctgacccaggctcgcaggagacgccaggctccagcccccaccaagtggaacaagaggaacctgtcgtggagggtccggacgttcccacgggactcaccactggggcacgacacggtgcgtgcactcatgtactacgccctcaaggtctggagcgacattgcgcccctgaacttccacgaggtggcgggcagcgccgccgacatccagatcgacttctccaaggccgaccataacgacggctaccccttcgacggccccggcggcaccgtggcccacgccttcttccccggccaccaccacaccgccggggacacccactttgacgatgacgaggcctggaccttccgctcctcggatgcccacgggatggacctgtttgcagtggctgtccacgagtttggccacgccattgggttaagccatgtggccgctgcacactccatcatgcggccgtactaccagggcccggtgggtgacccgctgcgctacgggctcccctacgaggacaaggtgcgcgtctggcagctgtacggtgtgcgggagtctgtgtctcccacggcgcagcccgaggagcctcccctgctgccggagcccccagacaaccggtccagcgccccgcccaggaaggacgtgccccacagatgcagcactcactttgacgcggtggcccagatccggggtgaagctttcttcttcaaaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggagacaggtactgggtgttcaaggacaataacgtagaggaaggatacccgcgccccgtctccgacttcagcctcccgcctggcggcatcgacgctgccttctcctgggcccacaatgacaggacttatttctttaaggaccagctgtactggcgctacgatgaccacacgaggcacatggaccccggctaccccgcccagagccccctgtggaggggtgtccccagcacgctggacgacgccatgcgctggtccgacggtgcctcctacttcttccgtggccaggagtactggaaagtgctggatggcgagctggaggtggcacccgggtacccacagtccacggcccgggactggctggtgtgtggagactcacaggccgatggatctgtggctgcgggcgtggacgcggcagaggggccccgcgcccctccaggacaacatgaccagagccgctcggaggacggttacgaggtctgctcatgcacctctggggcatcctctcccccgggggccccaggcccactggtggctgccaccatgctgctgctgctgccgccactgtcaccaggcgccctgtggacagcggcccaggccctgacgctatgacacacagcgcgagcccatgagaggacagaggcggtgggacagcctggccacagagggcaaggactgtgccggagtccctgggggaggtgctggcgcgggatgaggacgggccaccctggcaccggaaggccagcagagggcactgtccgccagggctgggcaggctcaggtggcaaggacggagctgtcccctagtgagggactgtgttgactgacgagccgaggggtggccgctccagaagggtgcccagtcaggccgcaccgccgccagcctcctccggccctggagggagcatctcgggctgggggcccacccctctctgtgccggcgccaccaaccccacccacactgctgcctggtgctcccgccggcccacagggcctccgtccccaggtccccagtggggcagccctccccacagacgagccccccacatggtgccgcggcacgtcccccctgtgacgcgttccagaccaacatgacctctccctgctttctagcggctcgg

SEQ ID NO: 151892 - DNA, 552 bp, Homo sapiens
  Payload ID: 9898
  Gene Symbol: MMP17
  Gene Name: matrix metallopeptidase 17 (membrane-inserted)
  ENST ID: ENST00000545790
  CDS Start-End: 208-552
cccggactctcgcggctgccgctgccgctgctgctgctgctggcgctggggacccgcgggggctgcgccgcgcccgcacccgcgccgcgcgccgaggacctcagcctgggagtggagtggctaagcaggttcggttacctgcccccggctgaccccacaacagggcagctgcagacgcaagaggagctgtctaaggccatcacagccatgcagcagtttggtggcctggaggccaccggcatcctggacgaggccaccctggccctgatgaaaaccccacgctgctccctgccagacctccctgtcctgacccaggctcgcaggagacgccaggctccagcccccaccaagtggaacaagaggaacctgtcgtggagggtccggacgttcccacgggactcaccactggggcacgacacggtgcgtgcactcatgtactacgccctcaaggtctggagcgacattgcgcccctgaacttccacgaggtggcgggcagcgccgccgacatccagatcgacttctccaaggccgaccataacgacggctacccc

SEQ ID NO: 151893 - DNA, 1510 bp, Homo sapiens
  Payload ID: 9898
  Gene Symbol: MMP17
  Gene Name: matrix metallopeptidase 17 (membrane-inserted)
  ENST ID: ENST00000534865
  CDS Start-End: 604-1510
caatctgcccaccctggcctcccaaagtgctggggttacaagtgtgagccaccacacccagccaaccctatttccaaaccaggtcatattctaaggttccggatggacgtgaatttggcgggacactatgtgacccactcaccttctgctgtcccccggagtcaaaactatctcagatgggccctggctagtgtgagggctggtgaaccgagagagccccttcagtggggagcagggggatggggcagacgggacgcaccgttgagggccctggggctgatggctccacgcgggagctgacgtttgcctgtggcctgggggtctcagcctgcctgggctctcatttccctccctccgtcatctatcccagtgaactactggaaccgccgtgagtgcatcggatgactcctggcgtggggaggaaggcggaagatgggggagaccctcataggggcacccccgggctgaggaggggcgttcagggaacctcggcctggggcacgtggcctgttctccgtgactcactctgggctgacccctgcctgcagggtccggacgttcccacgggactcaccactggggcacgacacggtgcgtgcactcatgtactacgccctcaaggtctggagcgacattgcgcccctgaacttccacgaggtggcgggcagcgccgccgacatccagatcgacttctccaaggccgaccataacgacggctaccccttcgacggccccggcggcaccgtggcccacgccttcttccccggccaccaccacaccgccggggacacccactttgacgatgacgaggcctggaccttccgctcctcggatgcccacgggatggacctgtttgcagtggctgtccacgagtttggccacgccattgggttaagccatgtggccgctgcacactccatcatgcggccgtactaccagggcccggtgggtgacccgctgcgctacgggctcccctacgaggacaaggtgcgcgtctggcagctgtacggtgtgcgggagtctgtgtctcccacggcgcagcccgaggagcctcccctgctgccggagcccccagacaaccggtccagcgccccgcccaggaaggacgtgccccacagatgcagcactcactttgacgcggtggcccagatccggggtgaagctttcttcttcaaaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggagacaggtactgggtgttcaaggacaataacgtagaggaaggatacccgcgccccgtctccgacttcagcctcccgcctggcggcatcgacgctgccttctcctgggcccacaatgacaggacttatttctttaaggaccagctgtactggcgctacgatgaccacacgaggcacatgg

SEQ ID NO: 151894 - DNA, 711 bp, Homo sapiens
  Payload ID: 9898
  Gene Symbol: MMP17
  Gene Name: matrix metallopeptidase 17 (membrane-inserted)
  ENST ID: ENST00000537848
  CDS Start-End: 391-510
agctcctgccctccccgcagctccctggcgctctgtatgctcagagcgtagatctcggcccccgcccgctgaagcggtggacaggcacccccgttttaatttgcctttagcagacctctaggcaaggataggggctccacacaaggatgcctgtcccatgccgctcaggtcaggggctctgccgcaggatgccctgtcccgcgctgcccaggccccgcctcccagcccacctggctctctccctgcaggcccaggaaggacgtgccccacagatgcagcactcactttgacgcggtggcccagatccggggtgaagctttcttcttcaaaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggaccagctgtactggcgctacgatgaccacacgaggcacatggaccccggctaccccgcccagagccccctgtggaggggtgtccccagcacgctggacgacgccatgcgctggtccgacggtgcctcctacttcttccgtggccaggagtactggaaagtgctggatggcgagctggaggtggcacccgggtacccacagtccacggcccgggactggctggtgtg

SEQ ID NO: 151895 - DNA, 775 bp, Homo sapiens
  Payload ID: 9898
  Gene Symbol: MMP17
  Gene Name: matrix metallopeptidase 17 (membrane-inserted)
  ENST ID: ENST00000545671
  CDS Start-End: 269-775
cgccgcggagagcggagggcgccgggctgcggaacgcgaagcggagggcgcgggaccctgcacgccgcccgcgggcccatgtgagcgccatgcggcgccgcgcagcccggggacccggcccgccgcccccagggcccggactctcgcggctgccgctgccgctgctgctgctgctggcgctggggacccgcgggggctgcgccgcgcccgcacccgcgccgcgcgccgaggacctcagcctgggagtgacgaggccaccctggccctgatgaaaaccccacgctgctccctgccagacctccctgtcctgacccaggctcgcaggagacgccaggctccagcccccaccaagtggaacaagaggaacctgtcgtggagggtccggacgttcccacgggactcaccactggggcacgacacggtgcgtgcactcatgtactacgccctcaaggtctggagcgacattgcgcccctgaacttccacgaggtggcgggcagcgccgccgacatccagatcgacttctccaaggccgaccataacgacggctaccccttcgacggccccggcggcaccgtggcccacgccttcttccccggccaccaccacaccgccggggacacccactttgacgatgacgaggcctggaccttccgctcctcggatgcccacgggatggacctgtttgcagtggctgtccacgagtttggccacgccattgggttaagccatgtggccgctgcacactccatcatgcggccgtactaccagggcccg

SEQ ID NO: 151896 - DNA, 719 bp, Homo sapiens
  Payload ID: 9898
  Gene Symbol: MMP17
  Gene Name: matrix metallopeptidase 17 (membrane-inserted)
  ENST ID: ENST00000535004
  CDS Start-End: 195-626
aggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggaccagctgtactggcgctacgatgaccacacgaggcacatggaccccggctaccccgcccagagccccctgtggaggggtgtccccagcacgctggacgacgccatgcgctggtccgacggtgcctcctacttcttccgtggccaggagtactggaaagtgctggatggcgagctggaggtggcacccgggtacccacagtccacggcccgggactggctggtgtgtggagactcacaggccgatggatctgtggctgcgggcgtggacgcggcagaggggccccgcgcccctccaggacaacatgaccagagccgctcggaggacggttacgaggtctgctcatgcacctctggggcatcctctcccccgggggccccaggcccactggtggctgccaccatgctgctgctgctgccgccactgtcaccaggcgccctgtggacagcggcccaggccctgacgctatgacacacagcgcgagcccatgagaggacagaggcggtgggacagcctggccacagagggcaaggactgtgccggagtccctgggggaggtgctgg

SEQ ID NO: 151897 - DNA, 2229 bp, Homo sapiens
  Payload ID: 9899
  Gene Symbol: MMP19
  Gene Name: matrix metallopeptidase 19
  Uniprot ID: Q99542
  ENST ID: ENST00000322569
  CDS Start-End: 93-1619
gagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcctgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctggggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataa

SEQ ID NO: 151898 - DNA, 1431 bp, Homo sapiens
  Payload ID: 9899
  Gene Symbol: MMP19
  Gene Name: matrix metallopeptidase 19
  Uniprot ID: Q99542
  ENST ID: ENST00000409200
  CDS Start-End: 107-1024
agaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcctgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctggcaagaagagtccagtgataagggatgaggaagaagaagagacagagctgcccactgtgcccccagtgcccacagaacccagtcccatgccagacccttgcagtagtgaactggatgccatgatgctgggtgaggcccctcccctccaggctgttggcaggcggtgggggcagcctgctgatcctgaggcctggacaaatgggagtgacatgggacttcagcatgagcaatggagggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaaggggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttc

SEQ ID NO: 151899 - DNA, 2350 bp, Homo sapiens
  Payload ID: 9899
  Gene Symbol: MMP19
  Gene Name: matrix metallopeptidase 19
  Uniprot ID: Q99542
  ENST ID: ENST00000552872
  CDS Start-End: 137-328
ataaagaggactagaggctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcctgtggactacctgtcacaatatgggtacctacagaagcctctagaaggatctaataacttcaagccagaagatatcaccgaggctctgagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctgggtgaggcccctcccctccaggctgttggcaggcggtgggggcagcctgctgatcctgaggcctggacaaatgggagtgacatgggacttcagcatgagcaatggagggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataa

SEQ ID NO: 151900 - DNA, 1813 bp, Homo sapiens
  Payload ID: 9899
  Gene Symbol: MMP19
  Gene Name: matrix metallopeptidase 19
  ENST ID: ENST00000548629
  CDS Start-End: 121-1578
gctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcctgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctggcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctggggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactc

SEQ ID NO: 151901 - DNA, 3840 bp, Homo sapiens
  Payload ID: 9899
  Gene Symbol: MMP19
  Gene Name: matrix metallopeptidase 19
  ENST ID: ENST00000548882
  CDS Start-End: 120-365
ctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcctgtggactacctgtcacaatatgggtacctacagaagcctctagaaggatctaataacttcaagccagaagatatcaccgaggctctgagggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctgggtgaggcccctcccctccaggctgttggcaggcggtgggggcagcctgctgatcctgaggcctggacaaatgggagtgacatgggacttcagcatgagcaatggaggttagaccccaggcattaatgaccatggaaggagacatgtgacatggggagggagagttcggagccaaattaaaggtggcttaggcaggcacttaccaaggctgccacgctctaagggccactagaacacatctggaaatgcagcaagatggagaaaactatattacccagattgcctgttagagagggtgcacctggttggaaggacaactaggaagccacttggaggggagggtgaggttcctaaggaggaatagctatctgcagggcttttgttttgttgagtggaccaaagctgaaacgctctgagcaacaaagcattctgagtcctctttgtctgcctttaattttctctttgaattaaagttgaatgaatttttgaagaatcagcctgcagggagagggcaaattgttagtcagcctgagatacccccaagtttctgtctacttgacctctgtctttttgacttgttgacacaccattacgctcagggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggtaaggaggctagttacagtgtcttacttgaggagggcctaatcttaaagaaactataaaagggagggagatgagaagtttctgaataggtggaccggaggagaccaaaagctatcacctgaggacagaggtgacttgttctttcctcacatgctctcaggagacaaggtgtggcgctacattaatttcaagatgtctcctggcttccccaagaagctgaatagggtagaacctaacctggatgcagctctctattggcctctcaaccaaaaggtgttcctctttaaggtataaagttcaaagcaagggcaaatcccttcttaggaggagtgggctaccttatactgagaagcaaagcttgcgcttgaagggagatgttctgcagctgcagtgggctgggggtggacccctgggggtcctaagctctctcctcttcctctcccctctccccacccatcccatatccagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataagagaggactgaacagctcttcctctagctgtctggctgtataactcttacagtagtctgtataataagggcatctctattagatctttaggggacagaggatttgtcaagatggttagctctttgttttggggtgcagagaaagaaaagagcagcaacagcagaggctggactccctggttcagtatttaatgccattttattcacatgctcccatgttctccctccctcccattgtagccttgctgcccaggggagggatatgtcttcctttatgcatctgggaaaccaggaacagaccctgcgcaggagagtcagagggggaagagttagaatgggtcagtggctggaacaaagttctggttaaggaggaaattagtgccacccacggtgagaagcagagaaggcacttgcatcctatgcagccctgaagaccaggctcctttgggcaaaaggcaagactctggcaggtgggtcaatgctctctccttggagcaagaagccagcttttggggaaggcaggtcctgaggcaggcactgccctgtggtcttccccaggttgaggagagaagtggaagccccatggaagacagtgctcccagctgaggtaggaggcggaggtgggggtgggggtagtttaagcctatggggcccagggggaaaggccaaacagaaacccaactaccccctaatgaagggcctggaggttggggtatcttggagctcctcagagcccttcttcccatcaaaaaggtatcaaatgccttggaagctccctgatcctacaaaacaaaaaaatgcttatttttaccactgtgaggcaagctgaggtgaacatttaaaaggctatttcaagacgaggtgcggtggctataatcctagcactttgggaggctgaagcaggaggatcacttgagcccaggagttcaagaccagcttgggcaacatagggagaccctgtctctgcaaaaaaataaaaacgaatacataaaaa

SEQ ID NO: 151902 - DNA, 946 bp, Homo sapiens
  Payload ID: 9899
  Gene Symbol: MMP19
  Gene Name: matrix metallopeptidase 19
  ENST ID: ENST00000552763
  CDS Start-End: 111-437
aaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcctgtggactacctgtcacaatatgggtacctacagaagcctctagaaggatctaataacttcaagccagaagatatcaccgaggctctgaggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctggcaagaagagtccagtgataagggatgaggaagaagaagagacagagctgcccactgtgcccccagtgcccacagaacccagtcccatgccagacccttgcagtagtgaactggatgccatgatgctgggtgaggcccctcccctccaggctgttggcaggcggtgggggcagcctgctgatcctgaggcctggacaaatgggagtgacatgggacttcagcatgagcaatggaggttagaccccaggcattaatgaccatggaaggagacatgtgacatggggagggagagttcggagccaaattaaaggtggcttaggcaggcacttaccaaggctgccacgctctaagggccactagaacacatctggaaatgcagcaagatggagaaaactatattacccagattgcctgttagagagggtgcacctggttggaaggacaact

SEQ ID NO: 151903 - DNA, 3741 bp, Homo sapiens
  Payload ID: 9900
  Gene Symbol: MMP2
  Gene Name: matrix metallopeptidase 2
  Uniprot ID: P08253
  ENST ID: ENST00000219070
  CDS Start-End: 510-2492
tggggtgacgaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttgaatcttattgatgaagaga

SEQ ID NO: 151904 - DNA, 2469 bp, Homo sapiens
  Payload ID: 9900
  Gene Symbol: MMP2
  Gene Name: matrix metallopeptidase 2
  Uniprot ID: P08253
  ENST ID: ENST00000437642
  CDS Start-End: 320-2152
aatgcatgcctgccctcctgggaatgaagcacagcaggtctcagcctcatcttacccagccccccactcaagatggaggtgcctggtttgaacacctctgacaaatggaagtctgtgttgtccagaggcaatgcagtgggggcttaagaagataactctggacttagaccgcttggcttcaaatcaaagagtgcatgaaccaaccagctggcctagtgatgatgttaggcaagtgacttctcagtttcttcatctgcaaactgggaaatttcctatctcagggttaaaagagaggtaatcttaggtgcttacctagcacatgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcag

SEQ ID NO: 151905 - DNA, 1978 bp, Homo sapiens
  Payload ID: 9900
  Gene Symbol: MMP2
  Gene Name: matrix metallopeptidase 2
  Uniprot ID: P08253
  ENST ID: ENST00000543485
  CDS Start-End: 141-1895
agatgttgtcttgtgagcgtgcgcgcgcctggctggaggggcactgagcctggccgcagtgttgccaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggagggg

SEQ ID NO: 151906 - DNA, 736 bp, Homo sapiens
  Payload ID: 9900
  Gene Symbol: MMP2
  Gene Name: matrix metallopeptidase 2
  ENST ID: ENST00000564864
  CDS Start-End: 134-736
tgtaaacaacttttggacacatctgggcagttgctaagggctcttgccaagcgtctagcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaa

SEQ ID NO: 151907 - DNA, 755 bp, Homo sapiens
  Payload ID: 9900
  Gene Symbol: MMP2
  Gene Name: matrix metallopeptidase 2
  ENST ID: ENST00000570283
  CDS Start-End: 1-755
ggcaccactgaggactacgaccgcgacaagaagtatggcttctgccctgagaccgggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcgg

SEQ ID NO: 151908 - DNA, 566 bp, Homo sapiens
  Payload ID: 9900
  Gene Symbol: MMP2
  Gene Name: matrix metallopeptidase 2
  ENST ID: ENST00000568715
  CDS Start-End: 212-566
gtgcagggtgtcctagccaagccggcgtccctcctagtagtaccgctgctctctaacctcaggacgtcaagggcctagagcgacagatgtttcccagcagggggttctgaggctgtgcgcccagatcgcgagagagcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgcct

SEQ ID NO: 151909 - DNA, 3235 bp, Homo sapiens
  Payload ID: 9900
  Gene Symbol: MMP2
  Gene Name: matrix metallopeptidase 2
  Uniprot ID: P08253
  ENST ID: ENST00000570308
  CDS Start-End: 686-2440
acatccgagatgaacccagcccttggtgttcaaaatcactttaaggggaagtagagctttttctttcatgtacctggaccagtagttcacttactctgaaagtcaagaggccccatggactgcccagcccagctgctgtggaatgtggcagagaaagagggtgagagggcctggatgactcccatgctgggagtattatgcaaacgtgggagaaaaaaacatgcttcctctcctggcctacaggagcgcttgaaagcctgctcatctgcaagccctagggctggactctacatcacagcagtggatactccatctccattgagaacccgatgactggtcactgcccagccccaccctcgacccaaccaggatgaagaatgggcaagccagatagctacagtaatcgacagacagacaaacaagagcatcgtatgacccaggggccaacaagtcccaccccagtgacaccatctcacttttgcagagctcttgctcgcaaagtgcagctaggagaacccaggcctcctgatgacaaatgctccttctttctgccccccacgtgccaagagcgaggagggaagatagctgctggctcactgtgtggtcgtggcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtg

SEQ ID NO: 151910 - DNA, 443 bp, Homo sapiens
  Payload ID: 9900
  Gene Symbol: MMP2
  Gene Name: matrix metallopeptidase 2
  ENST ID: ENST00000566564
  CDS Start-End: 1-68
agctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctgaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 151911 - DNA, 1956 bp, Homo sapiens
  Payload ID: 9901
  Gene Symbol: MMP20
  Gene Name: matrix metallopeptidase 20
  Uniprot ID: O60882
  ENST ID: ENST00000260228
  CDS Start-End: 14-1465
ctactgtgaggggatgaaggtgctccctgcatctggccttgctgtcttcctcatcatggctttgaagttttccactgcagccccctccctagttgcagcctcccccaggacctggaggaacaactaccgcctcgcacaggcgtatcttgacaaatattacacaaataaagaaggacaccagattggtgagatggttgcaagaggaagcaattccatgataaggaagattaaggagctacaagcgttctttggcctccaagtcaccgggaagttagaccagaccacaatgaacgtgatcaagaagcctcgctgtggagttcctgatgtggccaattatcgcctcttccctggtgaacccaaatggaaaaaaaatactttgacatacagaatatctaaatacacaccttccatgagttctgtcgaggtggacaaagcagtggagatggccttgcaggcctggagtagcgccgtccctctgagctttgtcagaataaactcaggagaagcggatattatgatatcttttgaaaatggagatcacggggattcctatccattcgatgggcctcgggggactctagcccatgcatttgctcctggagaaggcctgggaggagatacacatttcgacaatgctgagaagtggactatgggaacgaatggttttaatttgtttaccgttgctgctcatgaatttggccatgccctgggcctggcccattccacagacccatcagcactgatgtacccaacttataagtacaagaatccctatggattccacctccccaaagatgatgtgaaagggatccaggcattatacggacctcggaaagtattcctggggaagcccactctgccccatgccccccatcacaagccatccatccctgacctctgtgactccagctcatcctttgacgctgtgacaatgctggggaaggagctcctgctcttcaaggaccggattttctggagacggcaggttcacttgcggacaggaattcggcccagcactattaccagctccttcccccagctcatgtccaatgtggatgcagcttacgaagtggctgagaggggcactgcttacttcttcaaaggtccccactactggataacaagaggattccaaatgcaaggtcctcctcggactatttatgactttggatttccaaggcacgtgcagcaaatagatgctgctgtctacctcagggagccacagaagacccttttctttgtgggagatgaatactacagctacgacgaaaggaaaaggaaaatggaaaaagactatccaaagaatactgaagaagaattttcaggagtaaatggccaaatcgatgctgctgtagaattaaatggctacatttacttcttttcaggaccaaaaacatacaagtatgacacagagaaggaagatgtggttagtgtggtgaaatctagttcctggattggttgctaaatagaaaagcctagtcttctcaagcaatgaggatgactacaagcagcctctaactggatcttaaggactaaagcagaatgtaggagagggattcttccaaaggccttcaaatcaaattagaattcactgagaataataatacttccaatttttttcatagttgtataatcagaatttcaatccacattagaaaagtttttatatgggcaactttatgcgaaatccaaatcaacacaatgcactctgcagttagacaccattattttttcttacctaatatactgaagcagattgatccgtttgatttttatttccaggaggaagactagtggtggattccatgacatatattgtaattcttttcataggaaatgtcattacagtatgaattataattatttacaagcaatggcttttgtggccatcatttggccatcatttgttataataaatataaatttcccaatttttacttaaaagacatcacaaca

SEQ ID NO: 151912 - DNA, 1919 bp, Homo sapiens
  Payload ID: 9902
  Gene Symbol: MMP21
  Gene Name: matrix metallopeptidase 21
  Uniprot ID: Q8N119
  ENST ID: ENST00000368808
  CDS Start-End: 1-1710
atgctcgccgcctccatcttccgtccgacactgctgctctgctggctggctgctccctggcccacccagcccgagagtctcttccacagccgggaccgctcggacctggagccgtccccactgcgccaggccaagcccattgccgacctccacgctgctcagcggttcctgtccagatacggctggtcaggggtgtgggcggcctgggggcccagtcccgaggggccgccggagacccccaagggcgccgccctggccgaggcggtgcgcaggttccagcgggcgaacgcgctgccggccagcggggagctggacgcggccaccctagcggccatgaaccggccgcgctgcggggtcccggacatgcgcccaccgcccccctccgccccgccttcgcccccgggcccgccccccagagcccgctccaggcgctccccgcgggcgccgctgtccttgtcccggcggggttggcagccccggggctaccccgacggcggagctgcccaggccttctccaagaggacgctgagctggcggctgctgggcgaggccctgagcagccaactgtccgtggccgaccagcggcgcattgtggcgctggccttcaggatgtggagcgaggtgacgccgctggacttccgcgaggacctggccgcccccggggccgcggtcgacatcaagctgggctttgggagaggccggcacctgggctgtccgcgggccttcgatgggagcgggcaggagtttgcacacgcctggcgcctaggtgacattcactttgacgacgacgagcacttcacacctcccaccagtgacacgggcatcagccttctcaaggtggccgtccatgaaattggccatgtcctgggcttgcctcacacctacaggacgggatccataatgcaaccaaattacattccccaggagcctgcctttgagttggactggtcagacaggaaagcaattcaaaagctgtatggctcctgtgagggatcatttgatactgcgtttgactggattcgcaaagagagaaaccaatatggagaggtgatggtgagatttagcacatatttcttccgtaacagctggtactggctttatgaaaatcgaaacaataggacacgctatggggaccctatccaaatcctcactggctggcctggaatcccaacacacaacatagatgcctttgttcacatctggacatggaaaagagatgaacgttatttttttcaaggaaatcaatactggagatatgacagtgacaaggatcaggccctcacagaagatgaacaaggaaaaagctatcccaaattgatttcagaaggatttcctggcatcccaagtcccctagacacggcgttttatgaccgaagacagaagttaatttacttcttcaaggagtcccttgtatttgcatttgatgtcaacagaaatcgagtacttaattcttatccaaagaggattactgaagtttttccagcagtaataccacaaaatcatcctttcagaaatatagattccgcttattactcctatgcatacaactccattttctttttcaaaggcaatgcatactggaaggtagttaatgacaaggacaaacaacagaattcctggcttcctgctaatggcttatttccaaaaaagtttatttcagagaagtggtttgatgtttgtgacgtccatatctccacactgaacatgtaataagaaaaagtaggaaatggagggtcataggacttcgctaaaattctgatactgtttacaaagaaaaccggattttcagtagctgaagaaaatatggcactgtaagttaaaacccaatgggaaaagccttagttgaacttttaaaatacttgatttaaaaacaattgctcaggcaaaacataattcataaactaaaaggtttaaaaaaa

SEQ ID NO: 151913 - DNA, 1326 bp, Homo sapiens
  Payload ID: 9903
  Gene Symbol: MMP23B
  Gene Name: matrix metallopeptidase 23B
  Uniprot ID: O75900
  ENST ID: ENST00000356026
  CDS Start-End: 125-1297
caccgggctgtaacccgagccgccgagccactgcctcccctccggatcctccccggaggctctgcggcccgggcccccgcgccttgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctga

SEQ ID NO: 151914 - DNA, 1309 bp, Homo sapiens
  Payload ID: 9903
  Gene Symbol: MMP23B
  Gene Name: matrix metallopeptidase 23B
  ENST ID: ENST00000378675
  CDS Start-End: 41-1201
tgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggtgggcgcccgcccccgccccggcccggccctgcgcgcccggcctctcagccccgtgctccccccaggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctga

SEQ ID NO: 151915 - DNA, 750 bp, Homo sapiens
  Payload ID: 9903
  Gene Symbol: MMP23B
  Gene Name: matrix metallopeptidase 23B
  ENST ID: ENST00000435358
  CDS Start-End: 1-728
accacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggtgagtccctttgtcgggcgggagggcggggaccgggcggtcctgagccaggccgtgctccccacgctcccgataggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtg

SEQ ID NO: 151916 - DNA, 1531 bp, Homo sapiens
  Payload ID: 9903
  Gene Symbol: MMP23B
  Gene Name: matrix metallopeptidase 23B
  ENST ID: ENST00000512731
  CDS Start-End: 42-758
ttgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggtgaccgtccaggctggcctcctggaggcctctcctctgcagcacagtgggctgccgcggtcgggctttggggcagacggcaggagggaccttccggggtggtggctgccactggagtctagcaggcaaggaggggagcccgtgggagcccccatcccggcagccctgaactccctttcccatccccctgcgcctctggagcgggagctggagctgcattcctgggggccgagctcaccgcctgggcccagaacattcttatctttccgtggctgcggccgagggcggctccgcggctgcgctccagcagatacaccgggcctcggggagctggcccacgggcggcggggctgggcccggggctcccaggcgctgacccccggggcccgcaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggtgagtccctttgtcgggcgggagggcggggaccgggcggtcctgagccaggccgtgctccccacgctcccgataggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccct

SEQ ID NO: 151917 - DNA, 556 bp, Homo sapiens
  Payload ID: 9903
  Gene Symbol: MMP23B
  Gene Name: matrix metallopeptidase 23B
  ENST ID: ENST00000472264
  CDS Start-End: 57-556
ccgggcccccgcgccttgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagtccattttccgcggcagtttttggtcctggggaccgtcaccgatgcctcccacgcacgctttcttccctgaagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggatag

SEQ ID NO: 151918 - DNA, 903 bp, Homo sapiens
  Payload ID: 9903
  Gene Symbol: MMP23B
  Gene Name: matrix metallopeptidase 23B
  ENST ID: ENST00000479814
  CDS Start-End: 1-798
ggagacgtcgctgcgctgggcctctcggcggtcccccccacccgggtcccgggcccactggccccccgcagacgccgctacacgctgactccagccaggctgcgctgggaccacttcaacctcacctacaggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctc

SEQ ID NO: 151919 - DNA, 799 bp, Homo sapiens
  Payload ID: 9903
  Gene Symbol: MMP23B
  Gene Name: matrix metallopeptidase 23B
  ENST ID: ENST00000503792
  CDS Start-End: 1-777
accacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggtgaccgtccaggctggcctcctggaggcctctcctctgcagcacagtgggctgccgcggtcgggctttggggcagacggcaggagggaccttccggggtggtggctgccactggagtctagcaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtg

SEQ ID NO: 151920 - DNA, 530 bp, Homo sapiens
  Payload ID: 9903
  Gene Symbol: MMP23B
  Gene Name: matrix metallopeptidase 23B
  ENST ID: ENST00000490017
  CDS Start-End: 1-264
cccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctgatggctcctcgctcattcttgggagggcagcgggcagccagtctgggcaggtggacaccccagcccctggtccaccgagagctgggcgtcctcggggctgggcacccctgcttccccgcacagcggacaacagagcccggtggtctgcgactcccctcccacacatggtcccgggtcactcaaaggacgacacggggagctttcctcgaagaatattttaatacattttaaaactcaa

SEQ ID NO: 151921 - DNA, 1239 bp, Homo sapiens
  Payload ID: 9903
  Gene Symbol: MMP23B
  Gene Name: matrix metallopeptidase 23B
  Uniprot ID: O75900
  ENST ID: ENST00000412810
  CDS Start-End: 39-1211
ctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctg

SEQ ID NO: 151922 - DNA, 1308 bp, Homo sapiens
  Payload ID: 9903
  Gene Symbol: MMP23B
  Gene Name: matrix metallopeptidase 23B
  ENST ID: ENST00000618459
  CDS Start-End: 41-1201
tgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggtgggcgcccgcccccgccccggcccggccctgcgcgcccggcctctcagccccgtgctccccccaggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctg

SEQ ID NO: 151923 - DNA, 4414 bp, Homo sapiens
  Payload ID: 9904
  Gene Symbol: MMP24
  Gene Name: matrix metallopeptidase 24 (membrane-inserted)
  Uniprot ID: Q9Y5R2
  ENST ID: ENST00000246186
  CDS Start-End: 86-2023
gcgcggaggcgggggcgcgctggcggccgaggcggcggcggcggcggcgaaggcaggcgggccgggcgcgggccccgccgccgggatgccgaggagccggggcggccgcgccgcgccggggccgccgccgccgccgccgccgccgggccaggccccgcgctggagccgctggcgggtccctgggcggctgctgctgctgctgctgcccgcgctctgctgcctcccgggcgccgcgcgggcggcggcggcggcggcgggggcagggaaccgggcagcggtggcggtggcggtggcgcgggcggacgaggcggaggcgcccttcgccgggcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtggatgaagaaaccccgatgtggtgtccctgatcacccccacttaagccgtaggcggagaaacaagcgctatgccctgactggacagaagtggaggcaaaaacacatcacctacagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacgggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagt

SEQ ID NO: 151924 - DNA, 3554 bp, Homo sapiens
  Payload ID: 9905
  Gene Symbol: MMP25
  Gene Name: matrix metallopeptidase 25
  Uniprot ID: Q9NPA2
  ENST ID: ENST00000336577
  CDS Start-End: 238-1926
gattcccgggcccacccgacccagcggcgcgaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcctgggcgtggactggctgactcgctatggttacctgccgccaccccaccctgcccaggcccagctgcagagccctgagaagttgcgcgatgccatcaaagtcatgcagaggttcgcggggctgccggagaccggccgcatggacccagggacagtggccaccatgcgtaagccccgctgctccctgcctgacgtgctgggggtggcggggctggtcaggcggcgtcgccggtacgctctgagcggcagcgtgtggaagaagcgaaccctgacatggagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaagacggcgaggggaccgacctgtttgccgtggctgtccatgagtttggccacgccctgggcctgggccactcctcagcccccaactccattatgaggcccttctaccagggtccggtgggcgaccctgacaagtaccgcctgtctcaggatgaccgcgatggcctgcagcaactctatgggaaggcgccccaaaccccatatgacaagcccacaaggaaacccctggctcctccgccccagcccccggcctcgcccacacacagcccatccttccccatccctgatcgatgtgagggcaattttgacgccatcgccaacatccgaggggaaactttcttcttcaaaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcgggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggtgtagcctcccgctgatggggggagccatccagaccgaacagcgccctccacggccgagtcccccgccgctggacctggtcgggggttgtgaggcgctgcggaggccccttgtctgttcccacggacgggggctcgggcgcggactaagcaggggggatctcccgcgcaggggcggcggcggcggggaccggtcgcctggcgctgggctcagtctcctcagggtctgagaccccggcgctgccaccggaacccgccttcaggggcgcacgcgcgctgggaccatgcgtcggtcgtcgcccccgtcgttccctcccggctgccgccagggggcggtcggaccccgcctcccgagcccggggaggggcggggaggacaaggggcgggcccgcggcctcacccggagggacggcagccccggtcgcgcgctggccccgcaggaccttccttttccaggaagagccagcttttctcggagcgcagtcctgggactctccgcagccccgccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctggctgtttcgtggcatttctgtggctctgcagtgttcctccaccccaggaccaatatgttcaggccacaccgatggcctgaaccccatgggtagagtcacttaggggccacttcctaagttgctgtccagcctcagtgaccccctagtgcttcctggagctgaggctgtgggcggctgtcccagcaaccatgcgaggggttgccccagttgctcatacaaacagatcagcatgaggacagaaggcaggagactttggtcagttacctgggaattctgggctgccaggaaacgatttgggcctctgtcagtttcttttccatgtatgaggagggggaaatttgtatattagaaacttattcatcccactcaggacaataaaaacgaatgtacaaaaa

SEQ ID NO: 151925 - DNA, 1017 bp, Homo sapiens
  Payload ID: 9905
  Gene Symbol: MMP25
  Gene Name: matrix metallopeptidase 25
  ENST ID: ENST00000612971
  CDS Start-End: 466-1017
gattcccgggcccacccgacccagcggcgcgaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcctgggcgtggactggctgactcgctatggttacctgccgccaccccaccctgcccaggcccagctgcagagccctgagaagttgcgcgatgccatcaaagtcatgcagaggttcgcggggctgccggagaccggccgcatggacccagggacagtggccaccatgcgtaagccccgctgctccctgcctgacgtgctgggggtggcggggctggtcaggcggcgtcgccggtacgctctgagcggcagcgtgtggaagaagcgaaccctgacatggagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaagcctctcagcagctggagcaggagctggcaggcggctcaccggttgatgaggagctgggcttcagccggggctggcgtgtgaatcctctgggtcctggcagtcctgagcgcctgagctga

SEQ ID NO: 151926 - DNA, 989 bp, Homo sapiens
  Payload ID: 9906
  Gene Symbol: MMP26
  Gene Name: matrix metallopeptidase 26
  Uniprot ID: Q9NRE1
  ENST ID: ENST00000300762
  CDS Start-End: 19-804
gacaaatgagggtttggcatgcagctcgtcatcttaagagttactatcttcttgccctggtgtttcgccgttccagtgccccctgctgcagaccataaaggatgggactttgttgagggctatttccatcaatttttcctgaccaagaaggagtcgccactccttacccaggagacacaaacacagctcctgcaacaattccatcggaatgggacagacctacttgacatgcagatgcatgctctgctacaccagccccactgtggggtgcctgatgggtccgacacctccatctcgccaggaagatgcaagtggaataagcacactctaacttacaggattatcaattacccacatgatatgaagccatccgcagtgaaagacagtatatataatgcagtttccatctggagcaatgtgacccctttgatattccagcaagtgcagaatggagatgcagacatcaaggtttctttctggcagtgggcccatgaagatggttggccctttgatgggccaggtggtatcttaggccatgcctttttaccaaattctggaaatcctggagttgtccattttgacaagaatgaacactggtcagcttcagacactggatataatctgttcctggttgcaactcatgagattgggcattctttgggcctgcagcactctgggaatcagagctccataatgtaccccacttactggtatcacgaccctagaaccttccagctcagtgccgatgatatccaaaggatccagcatttgtatggagaaaaatgttcatctgacataccttaatgttagcacagaggacttattcaacctgtcctttcagggagtttattggaggatcaaagaactgaaagcactagagcagccttggggactgctaggatgaagccctaaagaatgcaacctagtcaggttagctgaaccgacactcaaaacgctactgagtcacaataaagattgttttaaagagt

SEQ ID NO: 151927 - DNA, 1189 bp, Homo sapiens
  Payload ID: 9906
  Gene Symbol: MMP26
  Gene Name: matrix metallopeptidase 26
  Uniprot ID: Q9NRE1
  ENST ID: ENST00000380390
  CDS Start-End: 217-1002
agtttcttacaaaatcgtcctatccagcatgcacttttggatactctttcaactcagaagtcaacataaagggtatggatgatgacgccactcacagattcaaagaaagggcaaactggcagagtgagtcattggatgttgctggcacagctataaagatccagtggcccaagttgtgtacctgaattcaagcagtgggacaaatgagggtttggcatgcagctcgtcatcttaagagttactatcttcttgccctggtgtttcgccgttccagtgccccctgctgcagaccataaaggatgggactttgttgagggctatttccatcaatttttcctgaccaagaaggagtcgccactccttacccaggagacacaaacacagctcctgcaacaattccatcggaatgggacagacctacttgacatgcagatgcatgctctgctacaccagccccactgtggggtgcctgatgggtccgacacctccatctcgccaggaagatgcaagtggaataagcacactctaacttacaggattatcaattacccacatgatatgaagccatccgcagtgaaagacagtatatataatgcagtttccatctggagcaatgtgacccctttgatattccagcaagtgcagaatggagatgcagacatcaaggtttctttctggcagtgggcccatgaagatggttggccctttgatgggccaggtggtatcttaggccatgcctttttaccaaattctggaaatcctggagttgtccattttgacaagaatgaacactggtcagcttcagacactggatataatctgttcctggttgcaactcatgagattgggcattctttgggcctgcagcactctgggaatcagagctccataatgtaccccacttactggtatcacgaccctagaaccttccagctcagtgccgatgatatccaaaggatccagcatttgtatggagaaaaatgttcatctgacataccttaatgttagcacagaggacttattcaacctgtcctttcagggagtttattggaggatcaaagaactgaaagcactagagcagccttggggactgctaggatgaagccctaaagaatgcaacctagtcaggttagctgaaccgacactcaaaacgctactgagtcacaataaagattgttttaaagagtaa

SEQ ID NO: 151928 - DNA, 1913 bp, Homo sapiens
  Payload ID: 9907
  Gene Symbol: MMP27
  Gene Name: matrix metallopeptidase 27
  Uniprot ID: Q9H306
  ENST ID: ENST00000260229
  CDS Start-End: 93-1634
aaatgatgatacaagccaattcatgccacgtctcactattattttctaaattctgtgctaacagaaccggcttcagctgaagaaagagaggaatgaagcgccttctgcttctgtttttgttctttataacattttcttctgcatttcccttagtccggatgacggaaaatgaagaaaatatgcaactggctcaggcatatctcaaccagttctactctcttgaaatagaagggaatcatcttgttcaaagcaagaataggagtctcatagatgacaaaattcgggaaatgcaagcattttttggattgacagtgactggaaaactggactcaaacacccttgagatcatgaagacacccaggtgtggggtgcctgatgtgggccagtatggctacaccctccctgggtggagaaaatacaacctcacctacagaataataaactatactccggatatggcacgagctgctgtggatgaggctatccaagaaggtttagaagtgtggagcaaagtcactccactaaaattcaccaagatttcaaaggggattgcagacatcatgattgcctttaggactcgagtccatggtcggtgtcctcgctattttgatggtcccttgggagtgcttggccatgcctttcctcctggtccgggtctgggtggtgacactcattttgatgaggatgaaaactggaccaaggatggagcaggattcaacttgtttcttgtggctgctcatgaatttggtcatgcactggggctctctcactccaatgatcaaacagccttgatgttcccaaattatgtctccctggatcccagaaaatacccactttctcaggatgatatcaatggaatccagtccatctatggaggtctgcctaaggaacctgctaagccaaaggaacccactataccccatgcctgtgaccctgacttgacttttgacgctatcacaactttccgcagagaagtaatgttctttaaaggcaggcacctatggaggatctattatgatatcacggatgttgagtttgaattaattgcttcattctggccatctctgccagctgatctgcaagctgcatacgagaaccccagagataagattctggtttttaaagatgaaaacttctggatgatcagaggatatgctgtcttgccagattatcccaaatccatccatacattaggttttccaggacgtgtgaagaaaatagatgcagccgtctgtgataagaccacaagaaaaacctacttctttgtgggcatttggtgctggaggtttgatgaaatgacccaaaccatggacaaagggttcccgcagagagtggtaaaacactttcctggaatcagtatccgtgttgatgctgctttccagtacaaaggattcttctttttcagccgtggatcaaagcaatttgaatacgacattaagacaaagaatattacccgaatcatgagaactaatacttggtttcaatgcaaagaaccaaagaactcctcatttggttttgatatcaacaaggaaaaagcacattcaggaggcataaagatattgtatcataagagtttaagcttgtttatttttggtattgttcatttgctgaaaaacacttctatttatcaataaattcatagacctaaaataaacctcaacaggtcttttaatataaattctgcttcaaaatagaataaaaccattctttaacaacaagttgctggtcctagttctaaatatccaaattcaatggccattttgagctgcctgattcttttaataggaagttattatgtagaaacaaaaatctctgactgtactttaagcctatttcatgctttgtggacttggagaagacatgtcttataactgaatactgaaacatttattaaaccaatctttagcattcta

SEQ ID NO: 151929 - DNA, 1928 bp, Homo sapiens
  Payload ID: 9908
  Gene Symbol: MMP28
  Gene Name: matrix metallopeptidase 28
  Uniprot ID: Q9H239
  ENST ID: ENST00000605424
  CDS Start-End: 206-1768
gacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtaacaaatggtacaagcagcacctctcctaccgcctggtgaactggcctgagcatctgccggagccggcagttcggggcgccgtgcgcgccgccttccagttgtggagcaacgtctcagcgctggagttctgggaggccccagccacaggccccgctgacatccggctcaccttcttccaaggggaccacaacgatgggctgggcaatgcctttgatggcccagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacctgggactcctacagcccccaaggaaggcgccctgaaacgcagggccctaaatactgccactcttccttcgatgccatcactgtagacaggcaacagcaactgtacatttttaaagggagccatttctgggaggtggcagctgatggcaacgtctcagagccccgtccactgcaggaaagatgggtcgggctgccccccaacattgaggctgcggcagtgtcattgaatgatggagatttctacttcttcaaagggggtcgatgctggaggttccggggccccaagccagtgtggggtctcccacagctgtgccgggcagggggcctgccccgccatcctgacgccgccctcttcttccctcctctgcgccgcctcatcctcttcaagggtgcccgctactacgtgctggcccgagggggactgcaagtggagccctactacccccgaagtctgcaggactggggaggcatccctgaggaggtcagcggcgccctgccgaggcccgatggctccatcatcttcttccgagatgaccgctactggcgcctcgaccaggccaaactgcaggcaaccacctcgggccgctgggccaccgagctgccctggatgggctgctggcatgccaactcggggagcgccctgttctgaaggcacctcctcacctcagaaactggtggtgctctcagggcaaaatcatgttccccacccccggggcagaacccctcttagaagcctctgagtccctctgcagaagaccgggcagcaaagcctccatctggaagtctgtctgcctttgttccttgaagaa

SEQ ID NO: 151930 - DNA, 2033 bp, Homo sapiens
  Payload ID: 9908
  Gene Symbol: MMP28
  Gene Name: matrix metallopeptidase 28
  ENST ID: ENST00000613289
  CDS Start-End: 248-1429
cggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtaacaaatggtacaagcagcacctctcctaccgcctggtgaactggcctgagcatctgccggagccggcagttcggggcgccgtgcgcgccgccttccagttgtggagcaacgtctcagcgctggagttctgggaggccccagccacaggccccgctgacatccggctcaccttcttccaaggggaccacaacgatgggctgggcaatgcctttgatggcccagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacctgggactcctacagcccccaaggaaggcgccctgaaacgcagggccctaaatactgccactcttccttcgatgccatcactgtagacaggcaacagcaactgtacatttttaaagggagccatttctgggaggtggcagctgatggcaacgtctcagagccccgtccactgcaggaaagatgggtcgggctgccccccaacattgaggctgcggcagtgtcattgaatgatggagatttctacttcttcaaagtgcaatccgtttgattgatatgaataccaaccatcgtgggctccagcttaaaggagagcagagggggtcgatgctggaggttccggggccccaagccagtgtggggtctcccacagctgtgccgggcagggggcctgccccgccatcctgacgccgccctcttcttccctcctctgcgccgcctcatcctcttcaagggtgcccgctactacgtgctggcccgagggggactgcaagtggagccctactacccccgaagtctgcaggactggggaggcatccctgaggaggtcagcggcgccctgccgaggcccgatggctccatcatcttcttccgagatgaccgctactggcgcctcgaccaggccaaactgcaggcaaccacctcgggccgctgggccaccgagctgccctggatgggctgctggcatgccaactcggggagcgccctgttctgaaggcacctcctcacctcagaaactggtggtgctctcagggcaaaatcatgttccccacccccggggcagaacccctcttagaagcctctgagtccctctgcagaagaccgggcagcaaagcctccatctggaagtctgtctgcctttgttccttgaagaa

SEQ ID NO: 151931 - DNA, 2336 bp, Homo sapiens
  Payload ID: 9908
  Gene Symbol: MMP28
  Gene Name: matrix metallopeptidase 28
  ENST ID: ENST00000619655
  CDS Start-End: 331-1863
agcagcggcgcggggtgggtggggcgggagtgccgggcctccgccccctccgcctgcctttccttcctccctccctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtaacaaatggtacaagcagcacctctcctaccgcctggtgaactggcctgagcatctgccggagccggcagttcggggcgccgtgcgcgccgccttccagttgtggagcaacgtctcagcgctggagttctgggaggccccagccacaggccccgctgacatccggctcaccttcttccaaggggaccacaacgatgggctgggcaatgcctttgatggcccagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacctgggactcctacagcccccaaggaaggcgccctgaaacgcagggccctaaatactgccactcttccttcgatgccatcactgtagggagccatttctgggaggtggcagctgatggcaacgtctcagagccccgtccactgcaggaaagatgggtcgggctgccccccaacattgaggctgcggcagtgtcattgaatgatggagatttctacttcttcaaagggggtcgatgctggaggttccggggccccaagccagtgtggggtctcccacagctgtgccgggcagggggcctgccccgccatcctgacgccgccctcttcttccctcctctgcgccgcctcatcctcttcaagggtgcccgctactacgtgctggcccgagggggactgcaagtggagccctactacccccgaagtctgcaggactggggaggcatccctgaggaggtcagcggcgccctgccgaggcccgatggctccatcatcttcttccgagatgaccgctactggcgcctcgaccaggccaaactgcaggcaaccacctcgggccgctgggccaccgagctgccctggatgggctgctggcatgccaactcggggagcgccctgttctgaaggcacctcctcacctcagaaactggtggtgctctcagggcaaaatcatgttccccacccccggggcagaacccctcttagaagcctctgagtccctctgcagaagaccgggcagcaaagcctccatctggaagtctgtctgcctttgttccttgaagaatgcagcattgtctttgtctgtccccaccacatggaggtgggggtgggatcaatcttaggaaaagcaaaaaagggtcccagatcccttggccctttcctccgaggacttctatcctccccaggcctttgtttcttcggctaaagcctgaggacaaagttctgggagatcggcattgactatgtaagtaacaacaacggcctaaagaagcaacaagaaaggaaccgagtgcctggagaacttcatggagcagagccacttgcctactttggatcatctgtctctaagagagggaaataaacatttcttttgtgtg

SEQ ID NO: 151932 - DNA, 436 bp, Homo sapiens
  Payload ID: 9908
  Gene Symbol: MMP28
  Gene Name: matrix metallopeptidase 28
  ENST ID: ENST00000615317
  CDS Start-End: 1-270
gactttgagacctgggactcctacagcccccaaggaaggcgccctgaaacgcagggccctaaatactgccactcttccttcgatgccatcactgtagacaggcaacagcaactgtacatttttaaagggagccatttctgggaggtggcagctgatggcaacgtctcagagccccgtccactgcaggaaagatgggtcgggctgccccccaacattgaggctgcggcagtgtcattgaatgatggagatttctacttcttcaaagcctgaggacaaagttctgggagatcggcattgactatgtaagtaacaacaacggcctaaagaagcaacaagaaaggaaccgagtgcctggagaacttcatggagcagagccacttgcctactttggatcatctgtctctaagagagggaaataaacatttcttttgtgtga

SEQ ID NO: 151933 - DNA, 2033 bp, Homo sapiens; identical to SEQ ID NO: 151930
  Payload ID: 9908
  Gene Symbol: MMP28
  Gene Name: matrix metallopeptidase 28
  ENST ID: ENST00000615136
  CDS Start-End: 248-1429

SEQ ID NO: 151934 - DNA, 1092 bp, Homo sapiens
  Payload ID: 9908
  Gene Symbol: MMP28
  Gene Name: matrix metallopeptidase 28
  Uniprot ID: Q9H239
  ENST ID: ENST00000612672
  CDS Start-End: 331-723
agcagcggcgcggggtgggtggggcgggagtgccgggcctccgccccctccgcctgcctttccttcctccctccctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtgagcactgttaaaatccggctaggccaagatttcccaatgtcttgaagccaatggctaggaaaacagctgagcctgggactggactttgtcagtaacctctcttccctagggcacgggaggagtgggtgaataggacctcttggcttgaggaccatgattgtgaatacagacatttaattcagaatgacacctacattgatgaattttcattgtacaagtgtttttccagatcaaacacaaaacccatgtaattccttgataaattttcaatgcagggcagataaactgttgctaacatttttcatttatatttactgaagttattttcatcagaattcattctttttcataagttattaaacaaatgtgtgatctattga

SEQ ID NO: 151935 - DNA, 2460 bp, Homo sapiens
  Payload ID: 9908
  Gene Symbol: MMP28
  Gene Name: matrix metallopeptidase 28
  Uniprot ID: Q9H239
  ENST ID: ENST00000611911
  CDS Start-End: 271-1833
tccttcctccctccctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtaacaaatggtacaagcagcacctctcctaccgcctggtgaactggcctgagcatctgccggagccggcagttcggggcgccgtgcgcgccgccttccagttgtggagcaacgtctcagcgctggagttctgggaggccccagccacaggccccgctgacatccggctcaccttcttccaaggggaccacaacgatgggctgggcaatgcctttgatggcccagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacctgggactcctacagcccccaaggaaggcgccctgaaacgcagggccctaaatactgccactcttccttcgatgccatcactgtagacaggcaacagcaactgtacatttttaaagggagccatttctgggaggtggcagctgatggcaacgtctcagagccccgtccactgcaggaaagatgggtcgggctgccccccaacattgaggctgcggcagtgtcattgaatgatggagatttctacttcttcaaagggggtcgatgctggaggttccggggccccaagccagtgtggggtctcccacagctgtgccgggcagggggcctgccccgccatcctgacgccgccctcttcttccctcctctgcgccgcctcatcctcttcaagggtgcccgctactacgtgctggcccgagggggactgcaagtggagccctactacccccgaagtctgcaggactggggaggcatccctgaggaggtcagcggcgccctgccgaggcccgatggctccatcatcttcttccgagatgaccgctactggcgcctcgaccaggccaaactgcaggcaaccacctcgggccgctgggccaccgagctgccctggatgggctgctggcatgccaactcggggagcgccctgttctgaaggcacctcctcacctcagaaactggtggtgctctcagggcaaaatcatgttccccacccccggggcagaacccctcttagaagcctctgagtccctctgcagaagaccgggcagcaaagcctccatctggaagtctgtctgcctttgttccttgaagaatgcagcattgtctttgtctgtccccaccacatggaggtgggggtgggatcaatcttaggaaaagcaaaaaagggtcccagatcccttggccctttcctccgaggacttctatcctccccaggcctttgtttcttcggctaaaggtacagttcctttcaagaggtaacagcactgggatccaagcagggggatgaaaaactcagcagagaaattcgagaccattttgcaagactgtgcccttctcctcaggaccccctggctcagttcttgaaaaacggtgtcatatttagtcagaggccccacccccaggaagcatggatggggatgaaggcacaggcgtctccaacctcagaggccctttgtggggtcaggacacagagtgggagggagactgatgcaggcctaccagtccctggctttttgtctggggctggaataaagaggtgccttcagctggtgggccgaga

SEQ ID NO: 151936 - DNA, 567 bp, Homo sapiens
  Payload ID: 9908
  Gene Symbol: MMP28
  Gene Name: matrix metallopeptidase 28
  ENST ID: ENST00000612292
  CDS Start-End: 1-567
aagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacc

SEQ ID NO: 151937 - DNA, 265 bp, Homo sapiens
  Payload ID: 9908
  Gene Symbol: MMP28
  Gene Name: matrix metallopeptidase 28
  ENST ID: ENST00000632913
  CDS Start-End: 1-265
gactttgagacctgggactcctacagcccccaaggaaggcgccctgaaacgcagggccctaaatactgccactcttccttcgatgccatcactgtagacaggcaacagcaactgtacatttttaaagggagccatttctgggaggtggcagctgatggcaacgtctcagagccccgtccactgcaggaaagatgggtcgggctgccccccaacattgaggctgcggcagtgtcattgaatgatggagatttctacttcttcaaag

SEQ ID NO: 151938 - DNA, 567 bp, Homo sapiens; identical to SEQ ID NO: 151936
  Payload ID: 9908
  Gene Symbol: MMP28
  Gene Name: matrix metallopeptidase 28
  ENST ID: ENST00000634159
  CDS Start-End: 1-567

SEQ ID NO: 151939 - DNA, 1092 bp, Homo sapiens; identical to SEQ ID NO: 151934
  Payload ID: 9908
  Gene Symbol: MMP28
  Gene Name: matrix metallopeptidase 28
  Uniprot ID: Q9H239
  ENST ID: ENST00000632360
  CDS Start-End: 331-723

SEQ ID NO: 151940 - DNA, 2166 bp, Homo sapiens
  Payload ID: 9908
  Gene Symbol: MMP28
  Gene Name: matrix metallopeptidase 28
  ENST ID: ENST00000631999
  CDS Start-End: 331-1863
agcagcggcgcggggtgggtggggcgggagtgccgggcctccgccccctccgcctgcctttccttcctccctccctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtaacaaatggtacaagcagcacctctcctaccgcctggtgaactggcctgagcatctgccggagccggcagttcggggcgccgtgcgcgccgccttccagttgtggagcaacgtctcagcgctggagttctgggaggccccagccacaggccccgctgacatccggctcaccttcttccaaggggaccacaacgatgggctgggcaatgcctttgatggcccagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacctgggactcctacagcccccaaggaaggcgccctgaaacgcagggccctaaatactgccactcttccttcgatgccatcactgtagggagccatttctgggaggtggcagctgatggcaacgtctcagagccccgtccactgcaggaaagatgggtcgggctgccccccaacattgaggctgcggcagtgtcattgaatgatggagatttctacttcttcaaagggggtcgatgctggaggttccggggccccaagccagtgtggggtctcccacagctgtgccgggcagggggcctgccccgccatcctgacgccgccctcttcttccctcctctgcgccgcctcatcctcttcaagggtgcccgctactacgtgctggcccgagggggactgcaagtggagccctactacccccgaagtctgcaggactggggaggcatccctgaggaggtcagcggcgccctgccgaggcccgatggctccatcatcttcttccgagatgaccgctactggcgcctcgaccaggccaaactgcaggcaaccacctcgggccgctgggccaccgagctgccctggatgggctgctggcatgccaactcggggagcgccctgttctgaaggcacctcctcacctcagaaactggtggtgctctcagggcaaaatcatgttccccacccccggggcagaacccctcttagaagcctctgagtccctctgcagaagaccgggcagcaaagcctccatctggaagtctgtctgcctttgttccttgaagaatgcagcattgtctttgtctgtccccaccacatggaggtgggggtgggatcaatcttaggaaaagcaaaaaagggtcccagatcccttggccctttcctccgaggacttctatcctccccaggcctttgtttcttcggctaaag

SEQ ID NO: 151941 - DNA, 2016 bp, Homo sapiens
  Payload ID: 9909
  Gene Symbol: MMP3
  Gene Name: matrix metallopeptidase 3
  Uniprot ID: P08254
  ENST ID: ENST00000299855
  CDS Start-End: 258-1691
aatcactgtgttgccttgcaaaattgggaaggttgagagaaattagtaaagtaggttgtatcatcctactttgaatttggaatgtttggaaatggtcctgctgccatttggatgaaagcaaggatgagtcaagctgcgggtgatccaaacaaacactgtcactctttaaaagctgcgctcccgaggttggacctacaaggaggcaggcaagacagcaaggcatagagacaacatagagctaagtaaagccagtggaaatgaagagtcttccaatcctactgttgctgtgcgtggcagtttgctcagcctatccattggatggagctgcaaggggtgaggacaccagcatgaaccttgttcagaaatatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtgatgcgcaagcccaggtgtggagttcctgatgttggtcacttcagaacctttcctggcatcccgaagtggaggaaaacccaccttacatacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagagaacatggagacttttacccttttgatggacctggaaatgttttggcccatgcctatgcccctgggccagggattaatggagatgcccactttgatgatgatgaacaatggacaaaggatacaacagggaccaatttatttctcgttgctgctcatgaaattggccactccctgggtctctttcactcagccaacactgaagctttgatgtacccactctatcactcactcacagacctgactcggttccgcctgtctcaagatgatataaatggcattcagtccctctatggacctccccctgactcccctgagacccccctggtacccacggaacctgtccctccagaacctgggacgccagccaactgtgatcctgctttgtcctttgatgctgtcagcactctgaggggagaaatcctgatctttaaagacaggcacttttggcgcaaatccctcaggaagcttgaacctgaattgcatttgatctcttcattttggccatctcttccttcaggcgtggatgccgcatatgaagttactagcaaggacctcgttttcatttttaaaggaaatcaattctgggctatcagaggaaatgaggtacgagctggatacccaagaggcatccacaccctaggtttccctccaaccgtgaggaaaatcgatgcagccatttctgataaggaaaagaacaaaacatatttctttgtagaggacaaatactggagatttgatgagaagagaaattccatggagccaggctttcccaagcaaatagctgaagactttccagggattgactcaaagattgatgctgtttttgaagaatttgggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctgtgtagactatttgcttatttaataaagacgatttgtcagttatttta

SEQ ID NO: 151942 - DNA, 296 bp, Homo sapiens
  Payload ID: 9909
  Gene Symbol: MMP3
  Gene Name: matrix metallopeptidase 3
  ENST ID: ENST00000434103
  CDS Start-End: 1-296
gaaatcaattctgggctatcagaggaaatgaggtacgagctggatacccaagaggcatccacaccctaggtttccctccaaccgtgaggaaaatcgatgcagccatttctgataaggaaaagaacaaaacatatttctttgtagaggacaaatactggagatttgatgagaagagaaattccatggagccaggctttcccaagcaaatagctgaagactttccagggattgactcaaagattgatgctgtttttgaagaatttgacagagctggcaccgagtgctgtctccattct

SEQ ID NO: 151943 - DNA, 559 bp, Homo sapiens
  Payload ID: 9909
  Gene Symbol: MMP3
  Gene Name: matrix metallopeptidase 3
  ENST ID: ENST00000524478
  CDS Start-End: 62-190
aaggaggcaggcaagacagcaaggcatagagacaacatagagctaagtaaagccagtggaaatgaagagtcttccaatcctactgttgctgtgcgtggcagtttgctcagcctatccattggatggagctgcaagggaaatatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtgatgcgcaagcccaggtgtggagttcctgatgttggtcacttcagaacctttcctggcatcccgaagtggaggaaaacccaccttacatacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagagaacatggagacttttacccttttgatgg

SEQ ID NO: 151944 - DNA, 1125 bp, Homo sapiens
  Payload ID: 9910
  Gene Symbol: MMP7
  Gene Name: matrix metallopeptidase 7
  Uniprot ID: P09237
  ENST ID: ENST00000260227
  CDS Start-End: 54-857
gaaaacaccaaatcaaccataggtccaagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaattta

SEQ ID NO: 151945 - DNA, 3056 bp, Homo sapiens
  Payload ID: 9911
  Gene Symbol: MMP8
  Gene Name: matrix metallopeptidase 8
  Uniprot ID: P22894
  ENST ID: ENST00000236826
  CDS Start-End: 100-1503
gacacatgatgctgtgaacgtcagggtgctcgccagggaagggccctacccagagggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcaggactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgaaatgaattttatttctctattctggccatcccttccaactggtatacaggctgcttatgaagattttgacagagacctcattttcctatttaaaggcaaccaatactgggctctgagtggctatgatattctgcaaggttatcccaaggatatatcaaactatggcttccccagcagcgtccaagcaattgacgcagctgttttctacagaagtaaaacatacttctttgtaaatgaccaattctggagatatgataaccaaagacaattcatggagccaggttatcccaaaagcatatcaggtgcctttccaggaatagagagtaaagttgatgcagttttccagcaagaacatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcaagcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatcttctacatgcaatttagaactagattttggttagaagtaaggattataaacaacctagacagtacccttggcctttacagaaaatatggtgctgttttctacccttggaaagaaatgtagatgatatgtttcgtgggttgaattgtgtcccccataaaagatatgttgaagttctaaccccaggtacccatgaatgtgagcttaccagggtctttgcagatgtaattagttaagttaaggtgagatcacactgaattagggtgggctctaaatccattatgactgttgttcttataagaagaagagaggcatagtcacctaggggaggaggccgtatgaagacagaggcagagattggagtgacgcatctccaagccaaggaattccaaggactgtaagccaccagtagaagctttgaagaggcaaggaaggattccctccaatagccttcaagtgtgaccctgctgacacctgcagaattcggacttctatcctccaaaaccgtgagggaataaatttcctttgttttaagccaccaactttgcaatactttgttacagcaaccctagacatgaggtactagacacagtacatctacacatatgaaaatgaatcaacacagaatgcagaagtagaacccttgctaaggactactgggcatcttcccaggacagcagccaaaagagaaccaccacttcctctcctgcctcctccttgctctctcctagagtccaaacccaaatgggccagttggatctgatgttcgtcagttctttacttctatttcctggggtactcaggagggcacacactatagataacttgggttagctgcataaaattcaatgtctcattaagttgcattaaactgagcttagatgtgtaagtttgctaacggatgggtttttttgttaagaactataggatttatgggaccaagtctagcgagtccagatatcaaaatcattataatgttatatttgctgttattagaatataatatagcttattatacaataaatatgtagactgtaaaatatatttctcactagtacctcctattttctttctctgttgaagtttttaaatcccacagataattaaattggcacctttatgcttgttcaaaaattaaaataatctattaaataagttcaaattaaagatttttacttcaaatgac

SEQ ID NO: 151946 - DNA, 1394 bp, Homo sapiens
  Payload ID: 9911
  Gene Symbol: MMP8
  Gene Name: matrix metallopeptidase 8
  ENST ID: ENST00000438475
  CDS Start-End: 1-1033
taaagagaaaaatacaaaaactgttcaggactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgaaatgaattttatttctctattctggccatcccttccaactggtatacaggctgcttatgaagattttgacagagacctcattttcctatttaaagatatgataaccaaagacaattcatggagccaggttatcccaaaagcatatcaggtgcctttccaggaatagagagtaaagttgatgcagttttccagcaagaacatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcaagcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtg

SEQ ID NO: 151947 - DNA, 2423 bp, Homo sapiens
  Payload ID: 9911
  Gene Symbol: MMP8
  Gene Name: matrix metallopeptidase 8
  ENST ID: ENST00000528662
  CDS Start-End: 216-326
gtaaatgactgatttgatttttgggggagagagcctgagagaactcagtcccagggaccagaagcagcaattgtttaagacatggctttaaagaggactgcaagagagctgtgagtgacacatgatgctgtgaacgtcagggtgctcgccagggaagggccctacccagagggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcagaataaataagccttttctacagtagtgaagaggataaaaaagaggaactgcactgatgcaacaaatacctcaagagaagtcaattaatgactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgaaatgaattttatttctctattctggccatcccttccaactggtatacaggctgcttatgaagattttgacagagacctcattttcctatttaaaggcaaccaatactgggctctgagtggctatgatattctgcaaggttatcccaaggatatatcaaactatggcttccccagcagcgtccaagcaattgacgcagctgttttctacagaagtaaaacatacttctttgtaaatgaccaattctggagatatgataaccaaagacaattcatggagccaggttatcccaaaagcatatcaggtgcctttccaggaatagagagtaaagttgatgcagttttccagcaagaacatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcaagcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatcttctacatgcaatttagaactagattttggttagaagtaaggattataaacaacctagacagtacccttggcctttacagaaaatatggtgctgttttctacccttggaaagaaatgtagatgatatgtttcgtgggttgaattgtgtcccccataaaagatatgttgaagttctaaccccaggtacccatgaatgtgagcttaccagggtctttgcagatgtaattagttaagttaaggtgagatcacactgaattagggtgggctctaaatccattatgactgttgttcttataagaagaagagaggcatagtcacctaggggaggaggccgtatgaagacaga

SEQ ID NO: 151948 - DNA, 598 bp, Homo sapiens
  Payload ID: 9911
  Gene Symbol: MMP8
  Gene Name: matrix metallopeptidase 8
  ENST ID: ENST00000532799
  CDS Start-End: 100-231
gacacatgatgctgtgaacgtcagggtgctcgccagggaagggccctacccagagggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcagagacaaaaatatcttaaatcagataaataatgtggccaagtgctcacagttaattcatggcagagttaagatttgaacccaggcctgtctgattccaaagcgtgtgatctgcacaaggccatctcagaagccaaccagatgcagccacctgatcttggacttcccagcctccagaattaataaataagccttttctacagtagtgaagaggataaaaaagaggaactgcactgatgcaacaaatacctcaagagaagtcaattaatgactacctggaaaagttctaccaattaccaagcaaccagtatcagtctacaaggaagaatggcactaatgtgatcgttgaaaagcttaaagaaatgcagcgattttttgggttgaatgtgacggggaagcc

SEQ ID NO: 151949 - DNA, 528 bp, Homo sapiens
  Payload ID: 9911
  Gene Symbol: MMP8
  Gene Name: matrix metallopeptidase 8
  ENST ID: ENST00000531168
  CDS Start-End: 98-268
cacatgatgctgtgaacgtcagggtgctcgccagggaagggccctacccagagggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcagcacaaggccatctcagaagccaaccagatgcagccacctgatcttggacttcccagcctccagaattaataaataagccttttctacagtagtgaagaggataaaaaagaggaactgcactgatgcaacaaatacctcaagagaagtcaattaatgactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtgga

SEQ ID NO: 151950 - DNA, 707 bp, Homo sapiens
  Payload ID: 9911
  Gene Symbol: MMP8
  Gene Name: matrix metallopeptidase 8
  ENST ID: ENST00000533258
  CDS Start-End: 87-257
gtgaacgtcagggtgctcgccagggaagggccctacccagagggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcagcacaaggccatctcagaagccaaccagatgcagccacctgatcttggacttcccagcctccagaattgactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttca

SEQ ID NO: 151951 - DNA, 2336 bp, Homo sapiens
  Payload ID: 9912
  Gene Symbol: MMP9
  Gene Name: matrix metallopeptidase 9
  Uniprot ID: P14780
  ENST ID: ENST00000372330
  CDS Start-End: 20-2143
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaaccttta

SEQ ID NO: 151952 - DNA, 9793 bp, Homo sapiens
  Payload ID: 9913
  Gene Symbol: MXRA5
  Gene Name: matrix-remodelling associated 5
  Uniprot ID: Q9NR99
  ENST ID: ENST00000217939
  CDS Start-End: 156-8642
gagctgcctcacccccggccccgggaagggcatggccccggcaaactcccggccgtgactcgcgcgccccggctcggtggatgctcccggcgcaccgctcccgtgtgcggcggcttcccaaggacaggtatccgagaatcaggcaccccgacaagatgcccaagcgcgcgcactggggggccctctccgtggtgctgatcctgctttggggccatccgcgagtggcgctggcctgcccgcatccttgtgcctgctacgtccccagcgaggtccactgcacgttccgatccctggcttccgtgcccgctggcattgctaaacacgtggaaagaatcaatttggggtttaatagcatacaggccctgtcagaaacctcatttgcaggactgaccaagttggagctacttatgattcacggcaatgagatcccaagcatccccgatggagctttaagagacctcagctctcttcaggttttcaagttcagctacaacaagctgagagtgatcacaggacagaccctccagggtctctctaacttaatgaggctgcacattgaccacaacaagatcgagtttatccaccctcaagctttcaacggcttaacgtctctgaggctactccatttggaaggaaatctcctccaccagctgcaccccagcaccttctccacgttcacatttttggattatttcagactctccaccataaggcacctctacttagcagagaacatggttagaactcttcctgccagcatgcttcggaacatgccgcttctggagaatctttacttgcagggaaatccgtggacctgcgattgtgagatgagatggtttttggaatgggatgcaaaatccagaggaattctgaagtgtaaaaaggacaaagcttatgaaggcggtcagttgtgtgcaatgtgcttcagtccaaagaagttgtacaaacatgagatacacaagctgaaggacatgacttgtctgaagccttcaatagagtcccctctgagacagaacaggagcaggagtattgaggaggagcaagaacaggaagaggatggtggcagccagctcatcctggagaaattccaactgccccagtggagcatctctttgaatatgaccgacgagcacgggaacatggtgaacttggtctgtgacatcaagaaaccaatggatgtgtacaagattcacttgaaccaaacggatcctccagatattgacataaatgcaacagttgccttggactttgagtgtccaatgacccgagaaaactatgaaaagctatggaaattgatagcatactacagtgaagttcccgtgaagctacacagagagctcatgctcagcaaagaccccagagtcagctaccagtacaggcaggatgctgatgaggaagctctttactacacaggtgtgagagcccagattcttgcagaaccagaatgggtcatgcagccatccatagatatccagctgaaccgacgtcagagtacggccaagaaggtgctactttcctactacacccagtattctcaaacaatatccaccaaagatacaaggcaggctcggggcagaagctgggtaatgattgagcctagtggagctgtgcaaagagatcagactgtcctggaagggggtccatgccagttgagctgcaacgtgaaagcttctgagagtccatctatcttctgggtgcttccagatggctccatcctgaaagcgcccatggatgacccagacagcaagttctccattctcagcagtggctggctgaggatcaagtccatggagccatctgactcaggcttgtaccagtgcattgctcaagtgagggatgaaatggaccgcatggtatatagggtacttgtgcagtctccctccactcagccagccgagaaagacacagtgacaattggcaagaacccaggggagtcggtgacattgccttgcaatgctttagcaatacccgaagcccaccttagctggattcttccaaacagaaggataattaatgatttggctaacacatcacatgtatacatgttgccaaatggaactctttccatcccaaaggtccaagtcagtgacagtggttactacagatgtgtggctgtcaaccagcaaggggcagaccattttacggtgggaatcacagtgaccaagaaagggtctggcttgccatccaaaagaggcagacgcccaggtgcaaaggctctttccagagtcagagaagacatcgtggaggatgaagggggctcgggcatgggagatgaagagaacacttcaaggagacttctgcatccaaaggaccaagaggtgttcctcaaaacaaaggatgatgccatcaatggagacaagaaagccaagaaagggagaagaaagctgaaactctggaagcattcggaaaaagaaccagagaccaatgttgcagaaggtcgcagagtgtttgaatctagacgaaggataaacatggcaaacaaacagattaatccggagcgctgggctgatattttagccaaagtccgtgggaaaaatctccctaagggcacagaagtacccccattgattaaaaccacaagtcctccatccttgagtctagaagtcacaccaccttttcctgctatttctcccccctcagcatctcctgtgcagacagtaaccagtgctgaagaatcctcagcagatgtacctctacttggtgaagaagagcacgttttgggtaccatttcctcagccagcatggggctagaacacaaccacaatggagttattcttgttgaacctgaagtaacaagcacacctctggaggaagttgttgatgacctttccgagaagactgaggagataacttccactgaaggagacctgaaggggacagcagcccctacacttatatctgagccttatgaaccatctcctactctgcacacattagacacagtctatgaaaagcccacccatgaagagacggcaacagagggttggtctgcagcagatgttggatcgtcaccagagcccacatccagtgagtatgagcctccattggatgctgtctccttggctgagtctgagcccatgcaatactttgacccagatttggagactaagtcacaaccagatgaggataagatgaaagaagacacctttgcacaccttactccaacccccaccatctgggttaatgactccagtacatcacagttatttgaggattctactataggggaaccaggtgtcccaggccaatcacatctacaaggactgacagacaacatccaccttgtgaaaagtagtctaagcactcaagacaccttactgattaaaaagggtatgaaagagatgtctcagacactacagggaggaaatatgctagagggagaccccacacactccagaagttctgagagtgagggccaagagagcaaatccatcactttgcctgactccacactgggtataatgagcagtatgtctccagttaagaagcctgcggaaaccacagttggtaccctcctagacaaagacaccacaacagcaacaacaacaccaaggcaaaaagttgctccgtcatccaccatgagcactcacccttctcgaaggagacccaacgggagaaggagattacgccccaacaaattccgccaccggcacaagcaaaccccacccacaacttttgccccatcagagactttttctactcaaccaactcaagcacctgacattaagatttcaagtcaagtggagagttctctggttcctacagcttgggtggataacacagttaatacccccaaacagttggaaatggagaagaatgcagaacccacatccaagggaacaccacggagaaaacacgggaagaggccaaacaaacatcgatataccccttctacagtgagctcaagagcgtccggatccaagcccagcccttctccagaaaataaacatagaaacattgttactcccagttcagaaactatacttttgcctagaactgtttctctgaaaactgagggcccttatgattccttagattacatgacaaccaccagaaaaatatattcatcttaccctaaagtccaagagacacttccagtcacatataaacccacatcagatggaaaagaaattaaggatgatgttgccacaaatgttgacaaacataaaagtgacattttagtcactggtgaatcaattactaatgccataccaacttctcgctccttggtctccactatgggagaatttaaggaagaatcctctcctgtaggctttccaggaactccaacctggaatccctcaaggacggcccagcctgggaggctacagacaggcatacctgttaccacttctggggaaaatcttacagaccctccccttcttaaagagcttgaggatgtggatttcacttccgagtttttgtcctctttgacagtctccacaccatttcaccaggaagaagctggttcttccacaactctctcaagcataaaagtggaggtggcttcaagtcaggcagaaaccaccacccttgatcaagatcatcttgaaaccactgtggctattctcctttctgaaactagaccacagaatcacacccctactgctgcccggatgaaggagccagcatcctcgtccccatccacaattctcatgtctttgggacaaaccaccaccactaagccagcacttcccagtccaagaatatctcaagcatctagagattccaaggaaaatgttttcttgaattatgtggggaatccagaaacagaagcaaccccagtgaacaatgaaggaacacagcatatgtcagggccaaatgaattatcaacaccctcttccgaccaggatgcatttaacttgtctacaaagctggaattggaaaagcaagtatttggtagtaggagtctaccacgtggcccagatagccaacgccaggatggaagagttcatgcttctcatcaactaaccagagtccctgccaaacccatcctaccaacagcaacagtgaggctgcctgaaatgtccacacaaagcgcttccagatactttgtaacttcccagtcacctcgtcactggaccaacaaaccggaaataactacatatccttctggggctttgccagagaacaaacagtttacaactccaagattatcaagtacaacaattcctctcccattgcacatgtccaaacccagcattcctagtaagtttactgaccgaagaactgaccaattcaatggctactccaaagtgtttggaaataacaacatccctgaggcaagaaacccagttggaaagcctcccagtccaagaattcctcattattccaatggaagactccctttctttaccaacaagactctttcttttccacagttgggagtcacccggagaccccagatacccacttctcctgccccagtaatgagagagagaaaagttattccaggttcctacaacaggatacattcccatagcaccttccatctggactttggccctccggcacctccgttgttgcacactccgcagaccacgggatcaccctcaactaacttacagaatatccctatggtctcttccacccagagttctatctcctttataacatcttctgtccagtcctcaggaagcttccaccagagcagctcaaagttctttgcaggaggacctcctgcatccaaattctggtctcttggggaaaagccacaaatcctcaccaagtccccacagactgtgtccgtcaccgctgagacagacactgtgttcccctgtgaggcaacaggaaaaccaaagcctttcgttacttggacaaaggtttccacaggagctcttatgactccgaataccaggatacaacggtttgaggttctcaagaacggtaccttagtgatacggaaggttcaagtacaagatcgaggccagtatatgtgcaccgccagcaacctgcacggcctggacaggatggtggtcttgctttcggtcaccgtgcagcaacctcaaatcctagcctcccactaccaggacgtcactgtctacctgggagacaccattgcaatggagtgtctggccaaagggaccccagccccccaaatttcctggatcttccctgacaggagggtgtggcaaactgtgtcccccgtggagggccgcatcaccctgcacgaaaaccggaccctttccatcaaggaggcgtccttctcagacagaggcgtctataagtgcgtggccagcaatgcagccggggcggacagcctggccatccgcctgcacgtggcggcactgccccccgttatccaccaggagaagctggagaacatctcgctgcccccggggctcagcattcacattcactgcactgccaaggctgcgcccctgcccagcgtgcgctgggtgctcggggacggtacccagatccgcccctcgcagttcctccacgggaacttgtttgttttccccaacgggacgctctacatccgcaacctcgcgcccaaggacagcgggcgctatgagtgcgtggccgccaacctggtaggctccgcgcgcaggacggtgcagctgaacgtgcagcgtgcagcagccaacgcgcgcatcacgggcacctccccgcggaggacggacgtcaggtacggaggaaccctcaagctggactgcagcgcctcgggggacccctggccgcgcatcctctggaggctgccgtccaagaggatgatcgacgcgctcttcagttttgatagcagaatcaaggtgtttgccaatgggaccctggtggtgaaatcagtgacggacaaagatgccggagattacctgtgcgtagctcgaaataaggttggtgatgactacgtggtgctcaaagtggatgtggtgatgaaaccggccaagattgaacacaaggaggagaacgaccacaaagtcttctacgggggtgacctgaaagtggactgtgtggccaccgggcttcccaatcccgagatctcctggagcctcccagacgggagtctggtgaactccttcatgcagtcggatgacagcggtggacgcaccaagcgctatgtcgtcttcaacaatgggacactctactttaacgaagtggggatgagggaggaaggagactacacctgctttgctgaaaatcaggtcgggaaggacgagatgagagtcagagtcaaggtggtgacagcgcccgccaccatccggaacaagacttacttggcggttcaggtgccctatggagacgtggtcactgtagcctgtgaggccaaaggagaacccatgcccaaggtgacttggttgtccccaaccaacaaggtgatccccacctcctctgagaagtatcagatataccaagatggcactctccttattcagaaagcccagcgttctgacagcggcaactacacctgcttggtcaggaacagcgcgggagaggataggaagacggtgtggattcacgtcaacgtccagccacccaagatcaacggtaaccccaaccccatcaccactgtgcgggagatagcagccgggggcagtcggaaactgattgactgcaaagctgaaggcatccccaccccgagggtgttatgggcttttcccgagggtgtggttctgccagctccatactatggaaaccggatcactgtccatggcaacggttccctggacatcaggagtttgaggaagagcgactccgtccagctggtatgcatggcacgcaacgagggaggggaggccaggttgatcctgcagctcactgtcctggagcccatggagaaacccatcttccacgacccgatcagcgagaagatcacggccatggcgggccacaccatcagcctcaactgctctgccgcggggaccccgacacccagcctggtgtgggtccttcccaatggcaccgatctgcagagtggacagcagctgcagcgcttctaccacaaggctgacggcatgctacacattagcggtctctcctcggtggacgccggggcctaccgctgcgtggcccgcaatgccgctggccacacggagaggctggtctccctgaaggtgggactgaagccagaagcaaacaagcagtatcataacctggtcagcatcatcaatggtgagaccctgaagctcccctgcacccctcccggggctgggcagggacgtttctcctggacgctccccaatggcatgcatctggagggcccccaaaccctgggacgcgtttctcttctggacaatggcaccctcacggttcgtgaggcctcggtgtttgacaggggtacctatgtatgcaggatggagacggagtacggcccttcggtcaccagcatccccgtgattgtgatcgcctatcctccccggatcaccagcgagcccaccccggtcatctacacccggcccgggaacaccgtgaaactgaactgcatggctatggggattcccaaagctgacatcacgtgggagttaccggataagtcgcatctgaaggcaggggttcaggctcgtctgtatggaaacagatttcttcacccccagggatcactgaccatccagcatgccacacagagagatgccggcttctacaagtgcatggcaaaaaacattctcggcagtgactccaaaacaacttacatccacgtcttctgaaatgtggattccagaatgattgcttaggaactgacaacaaagcggggtttgtaagggaagccaggttggggaataggagctcttaaataatgtgtcacagtgcatggtggcctctggtgggtttcaagttgaggttgatcttgatctacaattgttgggaaaaggaagcaatgcagacacgagaaggagggctcagccttgctgagacactttcttttgtgtttacatcatgccaggggcttcattcagggtgtctgtgctctgactgcaatttttctttttttgcaaatgccactcgactgccttcataagcgtccataggatatctgaggaacattcatcaaaaataagccatagacatgaacaacacctcactaccccattgaagacgcatcacctagttaacctgctgcagtttttacatgatagactttgttccagattgacaagtcatctttcagttatttcctctgtcacttcaaaactccagcttgcccaataaggatttagaaccagagtgactgatatatatatatattttaattcagagttacatacatacagctaccattttatatgaaaaaagaaaaacatttcttcctggaactcactttttatataatgttttatatatatattttttcctttcaaatcagacgatgagactagaaggagaaatactttctgtcttattaaaattaataaattattggtctttacaagacttggatacattacagcagacatggaaatataattttaaaaaatttctctccaacctccttcaaattcagtcaccactgttatattaccttctccaggaaccctccagtggggaaggctgcgatattagatttccttgtatgcaaagtttttgttgaaagctgtgctcagaggaggtgagaggagaggaaggagaaaactgcatcataactttacagaattgaatctagagtcttccccgaaaagcccagaaacttctctgcagtatctggcttgtccatctggtctaaggtggctgcttcttccccagccatgagtcagtttgtgcccatgaataatacacgacctgttatttccatgactgctttactgtatttttaaggtcaatatactgtacatttgataataaaataatattctcccaaaaa

SEQ ID NO: 151953 - DNA, 5661 bp, Homo sapiens
  Payload ID: 9914
  Gene Symbol: MXRA7
  Gene Name: matrix-remodelling associated 7
  Uniprot ID: P84157
  ENST ID: ENST00000355797
  CDS Start-End: 10-624
cgcggcgcgatggaggcgccggccgagctactggccgcgctgcctgcgctggccaccgcgctggcccttctgctcgcctggctactggtgcggcgtggggcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagagttcagaaggaacagctggctgccatcttcaagctcatgaaagacaacaaggagacgtttggcgagatgtccgacggcgacgtgcaggagcagctccggctctacgacatgtagactgcgcccacgggatgcacagcggccatgcctgatgctgtccccacccttgccccatgcccttgttctttccagacttctgtaggcctaattttcccttataaacatagatgcaggcgtacattctataggtacttgccgagttcttgcagtgtgtatattactttgcaggaatcaaaattgttttattcagaagacaaagtccctgacccctctggtttctgcttgctggtgaggttccagctgttattgggctctgaggccctctcctgatccaaatctttttttgtttgtttgagatggagtctcactctgtctcccaggctggagtgcagtggcgtgatcttggctcactgcaacctccacctccctgattcaagcgactctcctgcctcagcctcccgagtagctgggattgcaggcatgcaccatcacacctggctaattttgtattttcagtagagacagcgttttgccatgctggccaggctcgtctcgaactcctgacctcaggtgatccgcccaccttggcctcccaaagtgctgggattacacgcgtgagccaccatgcccggccaatactacactcttattctgccttacgaggatttctggaagcttctgtaactgtagggaagaaagctgtaggggagcatggtttttttgttttgtttttgtttttgagacgaggtctcactgtcacccaggctggagtgcagtggtgccatcatgactcactgcagccttgacctcccaggcgcacaaaatcctcctctcagcctgagtaactgggactacaggtgtgtaccactacatccagctaaaggagagcgtttttttctttttctttttgagacagagtctcactctggcgcctggtcactgtgcccttcaccttctgggttcaagtgattctcctgcctcagcctccctagtagctgggattacaggcatgcaccaccatacccagctaatttctgtatttttagtagagatggagtttcaccatgttggccaggctggtctcgaactcctgacctcaggtgatccacctgcctcggcctcccaaagtgctaggattacaggcgtgagccaccatgcccagctgggagcgttctttcagcaaaaagtctaattcagagactcaccttccatcctggcactaaacaatagtactagaggtaagatctgccaagaatttctctcacttaagcaggatacttactttaaatataattaggcaagacttatttgagtacttgcctaattgtatttaattagaactatgctggatgctgtagacagaagaaataaaatactcaacttggtccctatcttccagcaggttagaggcctttagggaagaaaagcctgtgtgcagggaaagagaacctcaccagaaagtattcaataaaatgccaaagtgatcttacagaacagtgcctgtgacaccggaggggattgttctgtctttgtgagtgaacatacaatgatggggataactggtcctcataccatgcaggtcccatttctgatcaccccactggcaggacaattcacagttcttgagcaaactgagttagggagggtatgctaacgacagaacctatgcaagttcttagaaatattttttgtttgctgaaataaagctcaatcaacacactaccttaaaaaaaaagtggagcagtggcatttccatgcctcatgctcaccatcatgaggttaacttcccgccgtcgcctcttgcctgccaggggtttttcgggagcccctctctgttccactctgattccttttgtttcttgctgaccattcactctctgtgtctgttgttggatccaaatacgagtgtttttctttctttttgtggtcagtgcttttttccttcttgaaattgttttaatgtgttttgtcaaaagcatttaaccatgttatgatttaagaattctctgttcacttgaggtcaggagttcaagaccagcctggccaatatggcaaaaccctgtctctactacaaatacaaaaattagccaggcgtggtagcgcacgcctgtaatcccagctactcaggagactgaggcaggagaatcgcttgaactcagaaggcggaggttccagtgagccatcgcgccactgcactctagcctgggtgacagagcaagactctgtctcaaaaaaaaaaaaaaaaaaaaaaaaaaattatttgttctgtctcaggtcttagggaccccttacctcagctaatgtctctgtcccctaaatgcacatcggtgggcagggcaaacccgtaggtgcccttatccctcccaaggctgcactgcaaagctcctgtgtttccattgcccactttcttctccctctcctttcttttctgattataccaaacaggaatgactcgtgtacttgagtcaaaatcctgatggcattgggaaaagtaaactgaaggaatttttgtacacttgtaccagctaagatgttctgactgcaacgacagaaaactccagctcaactggcttaaacaagaacagggctctctcacgtgagaagccaagagttagaacaactccaggcccagaatggtcggagctcaagctgcagttctcttagctcagtcttcctcgtactgtgggcttttattggagactagctctcctcatggtggcaagatggctgcaggagttcaggtatctcatccagaagcaagaaaagggcatgtcttgcttgcgtctctaggcgtaagggaactggtccagatgtccccgccccacatcccttcagatcccaattggccagaatatggcacgtgcccatgtttcaaccaatcatgggcaaggacatgggaccagcatgattggcctagacccctggagcctggggctgggcccagcatcccctgaatacatggccatctggaggagaaggtaactgaatttcactggggatctgtgataaaagggagcatgggtgttggggagacacctgttccagttgggtttcctatgaggtccaggacagggcttggtgggcactcggaagccagtgtctgaagtgctcagcatcctcctcttcctcggtggtgggtgtccaccgcccaggccccacccctggccttggacacttcatggaaacactgctgatttgctgtggtgttgggtggctcctatctattccccgtaagtgctggcctctgttgacaccatttctgctacctcatctgagattgttctcatcagctcacagagattcatttcagtgaatgaaccaaatctaagctaaaaagcataaaggagggcagaaagaaacagcagtgtgggagaaagagcgcaaacaccgagagaaagatgtctacctggcagccatgtcagagaatcaccagtatgtatgtcactgccaccaagaacctaagagccacagaggcctacagaagccaatcccaatggaactctctctgggtgtgggggttgagagaacctaaagcattcagctgcacagagcctctttccagcgatgggaaccagtctcaaagcctttacatctctcccctgccctccatcactgctgagaaccctgccccaggctggcctgcctacatgacacaaatagcagtggactgtcactcatcagtatctgcagttctgtttaccaaagcctgcttgctagagacgtttcagggcctccttccctcaaagcgtccactgtacctccatctggatacaattagctggctccccacttcctggactgacggtaaccaccttttccaatgaccctgaagaaaacatgcaatctaagctgctttaagagtaacctacaactgaggacaaattttctatcaactcccagtacccctctctgccgtggctgatttgttactggttttccttttttttttttaatttgaaaatgtaagtaattatactaagaccagatcactctgagattgttttattctaatttgtcctaaggacctgcctgtacttagagcctgatagaaagcccaagttgatctactgggcagctctctgggcctggaaggaagagcacacaacaagacttcaacagtgagcctggctaggtccaggcagaccatgatttctgaaagcaacagtatagtccacatggaatcaggctgctgatgaacagcagcgagaggctgcctctgaatcatatctgcagggtcacctgcgcctggtggaggcccacagtcatccattaggccccagtatcctatgtgggagtatccacgtctagtctctacttctcactgcaggagaggtggcagatgaggaggtttcctactttaaagaaagtagaagttgtttcctttcttccctcctcacagccttgagggggaggttgtgcccagcctgacagcagctgccttgcccaagattacatcctgttctgggggcagcccacctccaaaccaagtcactagtggggtacaaaggcctgccctctctgccaaaaggcaggtgctgatggaccattccagttctagagttcccaaagagacgtctttttggagagcggcagggtaccagaaatccttcactcaggctatagcatggccaccaattataagtaacttgaggcccacccagccaaacatgcctttccgggtctagtgctgggttccagaacaggaagcctggcagattcctactgccacagattctttttactattattattgtcaccttatttttcttttggtggaacccctctagggcttccaccggattctccaccatttacgctatcaattttatcagttttggttttatcgtttcagtgcttctttttgctaacggtagcagccaatatacatcatctctggagacaaatcacgccatagaaaatattgtagttttcctcatttttcttaacgccacagagtcagctgggctgtagtaccagcccggatgtaccagtttactcagccactccccctctcatggacatctgcatggtttccagtcttgcaaattcatacagtgccactacaaataaaaccttgcgcgtatgctgttttca

SEQ ID NO: 151954 - DNA, 1950 bp, Homo sapiens
  Payload ID: 9914
  Gene Symbol: MXRA7
  Gene Name: matrix-remodelling associated 7
  Uniprot ID: P84157
  ENST ID: ENST00000375036
  CDS Start-End: 59-592
ggggcgcggcgggctccctcggggtcccagctggcccgcactcggcggccgcggcgcgatggaggcgccggccgagctactggccgcgctgcctgcgctggccaccgcgctggcccttctgctcgcctggctactggtgcggcgtggggcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagaggattgagctgacctctgacctcacttccctgtagcaagttccttaggtcctgagccacaaatattcttgcaaatccttttgaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaa

SEQ ID NO: 151955 - DNA, 1881 bp, Homo sapiens
  Payload ID: 9914
  Gene Symbol: MXRA7
  Gene Name: matrix-remodelling associated 7
  Uniprot ID: P84157
  ENST ID: ENST00000449428
  CDS Start-End: 71-583
gggcgcggcgacggggcgcggcgggctccctcggggtcccagctggcccgcactcggcggccgcggcgcgatggaggcgccggccgagctactggccgcgctgcctgcgctggccaccgcgctggcccttctgctcgcctggctactggtgcggcgtggggcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaa

SEQ ID NO: 151956 - DNA, 3510 bp, Homo sapiens
  Payload ID: 9914
  Gene Symbol: MXRA7
  Gene Name: matrix-remodelling associated 7
  ENST ID: ENST00000592148
  CDS Start-End: 1573-2214
ctgctgacagtttctcgtgggcccttccaaaaaacaaaccttttctctgcattttcgagcacatgcgtgcatttccactttgccatttacagcaagatgactgcgctgctcacgtggggctgctgcttgcatttttccctcgatttatcttgatgtacttttcatgtcagcacctatcaacgcctcctttttttttttttttctttttttaagatgcagtcttgctgtgtcactaggctggagtgcaatggcgcaatcttggcttactgcaacctccacctcccgggttcaagcgattctcctgcctcaacctcctgagtagctgggattaaaggcacctgccacaacactcggctaatttttttttgtatttttagtagagacggggttttgccatgttggccaggctggtctcgaattcccaacctcagctgatccacccacctaggcctcccaaaattctgggattacaggcgtgagcgaccgcacccggtccccagttctgtcttttcaactgcacgcggtcagagtcattatataaaaatcctgatggacatttctccagtctggagcagatccctagaagtgggtttgctgtgtcaaatggagcggctcctcttcctgcccccggaagaggcctgcccactccgacctcagccatagagatactttgctgtgcaaaatttgggaaacgtcaggacacacaggcaccacttcgccatagatagcactaagtctgtgtgtacaaagtgcccaacagggaagacgctgtgttgcctgcgcagctccccccaggcagcattttgtgtagtcaaggaagtccctcaggccaggcacagtggctcactcctgtaatcccaacactctgggaggccgaggcaggcggatcacctgaggtcaggggttcgagaccagcccggccaacatggtgacatgccatctctactgaaaacacaaaaaaattagctgggcttgggtggcgggcgcccgtaatcccagctactcgggaggctgaggcaggagaatcgcttaaacccaggaggcagacgttgcagtgagccgagatcgcgccactgcacgccagcctgggcaacaagagccaaaactctgtctcagaaacacactcagaaaaaaacagaaaccaaacaaacaaaaagtcactcagaggagctcaaggcccctctgggtttgccacttccgacccgctgtggggcttgtaaaaactttgcctcccggcacagctcagtgttttgttagggagcctcccgtgagcggccgacgctggctgggctccatgggatcagctggggctgctcattcattcatttccacatctacccactgggcttccaagttgaagttcctggggctcccatgtcccctccccatgaccttcaatcccacagagcccatgggcacggcacgtcgctctcatcctctgacattcctgcaagctgaagtcacttcttccttccaccaaggccatcccgggccattcctctgatcatctgtttattgtgtctctgtgtgggagagaactggctgaagaggtggggctccagttttgggaacatggacactgagagagttggggatggaaaacaacatagaaggaagcaaagccagaggctgcgatggccatgctgcctggccctggtcccagacagacaccccagccagctttcctcttgcaccctttgtctgctggccgcagcgtcgcagtgggagtcctgggcccacttctccaaatggcacacagaagcctcaacaggcacccacctgggaaaggccaaggccgagggcttggggtgcacagtcaagaacacgcctcagctcagcatttgtgagccgagtcactttggcccatcgtttgtacacagcccccacctgctggttgaccatgaccacagggcaggcgctgccacagggcgtgggcaggctggaccttcgagggcctcctctgtctcccctaccttctgcccccccaccacttcccatcacccagtctgtgccaagggcactgaccctgtccttgtcttgcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctc

SEQ ID NO: 151957 - DNA, 540 bp, Homo sapiens
  Payload ID: 9914
  Gene Symbol: MXRA7
  Gene Name: matrix-remodelling associated 7
  ENST ID: ENST00000585519
  CDS Start-End: 160-207
attgtgtctctgtgtgggagagaactggctgaagaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacacctt

SEQ ID NO: 151958 - DNA, 560 bp, Homo sapiens
  Payload ID: 9914
  Gene Symbol: MXRA7
  Gene Name: matrix-remodelling associated 7
  ENST ID: ENST00000589082
  CDS Start-End: 342-410
atctacccactgggcttccaagttgaagttcctggggctcccatgtcccctccccatgaccttcaatcccacagagcccatgggcacggcacgtcgctctcatcctctgacattcctgcaagctgaagtcacttcttccttccaccaaggccatcccgggccattcctctgatcatctgtttattgtgtctctgtgtgggagagaactggctgaagaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagaggattgagctgacctctgacctcacttccctgtagcaagttccttaggtcctgagccacaaatattcttgcaaatccttttgaactgaagaataacgaagttatccttagcgtcctcctaaaggcttttccttttggcatcttaaaagcttgagagataaaacggaaaccccagagaggagtctg

SEQ ID NO: 151959 - DNA, 521 bp, Homo sapiens
  Payload ID: 9914
  Gene Symbol: MXRA7
  Gene Name: matrix-remodelling associated 7
  ENST ID: ENST00000588114
  CDS Start-End: 224-271
actctgtcctgtgctggacacaatggtttaccctggagagaagcccttcgggggaggaggaggcagccaggctgtgctcagaggcatttctctttgctgagaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaa

SEQ ID NO: 151960 - DNA, 2273 bp, Homo sapiens
  Payload ID: 9915
  Gene Symbol: MXRA8
  Gene Name: matrix-remodelling associated 8
  Uniprot ID: Q9BRK3
  ENST ID: ENST00000309212
  CDS Start-End: 32-1360
gtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctcccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtcgggggctgggagatgttcctggaggaggacactcccatcagaacttggcagccttgaagttggggtcagcctcggcaggagtcccactcctcctggggtgctgcctgccaccgagagctcccccacctgtaccaccatgtgggactccaggcaccatctgttctccccagggacctgctgacttgaatgccagcccttgctcctctgtgttgctttgggccacctggggctgcaccccttgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 151961 - DNA, 2231 bp, Homo sapiens
  Payload ID: 9915
  Gene Symbol: MXRA8
  Gene Name: matrix-remodelling associated 8
  Uniprot ID: Q9BRK3
  ENST ID: ENST00000342753
  CDS Start-End: 291-1316
atgtcctcggaccttcttgtccctccaagggtgcggtcaccacccctccccaggcctgaccggtgaggggctgggcctctgctcccacactgcccctccccagcaggccagcaacgatgggggaggccaaggggcccggcaggagccagagggggcggtccccagaccgtagacaggcccaggcctccgtgatgtcaccgcgggtgctaaggagggggagggggtagggctgtttttctggagagagacttagagccgagtgggacaaagcctggggctgggcgggggccatggcgctgccatcccgaatcctgctttggaaacttgtgcttctgcagagctctgctgttctcctgcactcagcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctcccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtcgggggctgggagatgttcctggaggaggacactcccatcagaacttggcagccttgaagttggggtcagcctcggcaggagtcccactcctcctggggtgctgcctgccaccgagagctcccccacctgtaccaccatgtgggactccaggcaccatctgttctccccagggacctgctgacttgaatgccagcccttgctcctctgtgttgctttgggccacctggggctgcaccccttgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgatttttaga

SEQ ID NO: 151962 - DNA, 2001 bp, Homo sapiens
  Payload ID: 9915
  Gene Symbol: MXRA8
  Gene Name: matrix-remodelling associated 8
  Uniprot ID: Q9BRK3
  ENST ID: ENST00000445648
  CDS Start-End: 40-1392
agagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagcctcctctcctcccacagattacaaaaacaacatcctgaaggagagggcggagctggcccacagccccctgcctgccaagtacatcgacctagacaaagacccttctgggctctgcccgctgggggcctgaagacattcctggaggacactcccatcagaacctggcagccccaaaactggggtcagcctcagggcaggagtcccactcctccagggctctgctcgtcgggggctgggagatgttcctggaggaggacactcccatcagaacttggcagccttgaagttggggtcagcctcggcaggagtcccactcctcctggggtgctgcctgccaccgagagctcccccacctgtaccaccatgtgggactccaggcaccatctgttctccccagggacctgctgacttgaatgccagcccttgctcctctgtgttgctttgggccacctggggctgcaccccttgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttt

SEQ ID NO: 151963 - DNA, 2728 bp, Homo sapiens
  Payload ID: 9915
  Gene Symbol: MXRA8
  Gene Name: matrix-remodelling associated 8
  Uniprot ID: Q9BRK3
  ENST ID: ENST00000477278
  CDS Start-End: 515-1816
aagaaggctggcggtgtttcctcttagaggggagaaactcagcctgggtaggagacccagccccacgcagggaaaactgtgctaacgcttccgatgtgcgtggcaggtgcggcggcggcgaatacggtttgtcctcgagcctaaccctgtctgtgttggtgtcagcagtggcccccctaccacacacacagggtccctggcgtcccaagaccactcctggcagccccgccactggctgcgcctggaagccgcgtcctcaggcctcgcctggcatttgctgtcacagaggttgcttccttgggtccgtccgtcctcgcccctccagcctgggcgccccccgacccctgtctcattccctccaccacatgcagcacagtccaggaggctggggtccaagagggccatggctggcacccggcttagtgctgagtccccagtgcccagcaagcctggcacccaggaggtggtcagcaaacgcttctgaacgacaggaagtgggactcttcagccatcgatgatccgctgtgcggccacaggctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctcccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtcgggggctgggagatgttcctggaggaggacactcccatcagaacttggcagccttgaagttggggtcagcctcggcaggagtcccactcctcctggggtgctgcctgccaccgagagctcccccacctgtaccaccatgtgggactccaggcaccatctgttctccccagggacctgctgacttgaatgccagcccttgctcctctgtgttgctttgggccacctggggctgcaccccttgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttt

SEQ ID NO: 151964 - DNA, 570 bp, Homo sapiens
  Payload ID: 9916
  Gene Symbol: MTCP1
  Gene Name: mature T-cell proliferation 1
  Uniprot ID: P56278
  ENST ID: ENST00000362018
  CDS Start-End: 164-487
gatttacaaaggaatgaatctgcatgaaagtttaccaacaagatccctgcctgccttttgcaggctctcctgcaaccatctacttcatttttgatctcaggaagaccagagctgaggcttaggtggagaaaagcagggctagaattggaacccaaagcccagaatggcaggagaggatgtgggggctccacccgatcacctctgggttcaccaagagggtatctaccgcgacgaataccagcgcacgtgggtggccgtcgtggaagaggagacgagtttcctaagggcacgagtccagcaaattcaggttcccttaggtgacgcagctaggccaagtcaccttcttacctcccagctacctctcatgtggcaactctacccggaggagcgctacatggataacaactctcgcttgtggcagatacagcatcatttaatggtcaggggagtacaggagctgttgcttaagcttttgcctgatgactaacctggtgctgggattctacgaagatatgctcctttgttctgttcagtatttggcaatcacttcatccactactgcagtgcacc

SEQ ID NO: 151965 - DNA, 2274 bp, Homo sapiens
  Payload ID: 9916
  Gene Symbol: MTCP1
  Gene Name: mature T-cell proliferation 1
  Uniprot ID: P56278
  ENST ID: ENST00000369476
  CDS Start-End: 581-904
ggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatgcttaggtggagaaaagcagggctagaattggaacccaaagcccagaatggcaggagaggatgtgggggctccacccgatcacctctgggttcaccaagagggtatctaccgcgacgaataccagcgcacgtgggtggccgtcgtggaagaggagacgagtttcctaagggcacgagtccagcaaattcaggttcccttaggtgacgcagctaggccaagtcaccttcttacctcccagctacctctcatgtggcaactctacccggaggagcgctacatggataacaactctcgcttgtggcagatacagcatcatttaatggtcaggggagtacaggagctgttgcttaagcttttgcctgatgactaacctggtgctgggattctacgaagatatgctcctttgttctgttcagtatttggcaatcacttcatccactactgcagtgcacccacccttgggcctggggggagggagtgggttgaaaaactgctcaagaaacagaagtttagcaagggtcatgaagaatactgcaagtgaaactgcagagagaggttacgtaggcagaaagcaagtcaacaaaagcacttagtcaggatccgtaacttgaaattgactcctttggaaattgccatagaacccttaatggacatcatcggctggacctgggatctgatgaatcccacaaaagtcagcaccttctacagaacagatgccctgatcaccaaggacttggtactgatttagagagaagagagcagctcctagcagcatcaacatctatttgtcgcttatttgccctgcagcaattcacctgcctttccttctcccatcctgtaaatatcctaggttttgctccagtgtttcccatcccagtactgacctaatttggatctgctgagtatttagagggctctgaaaagagatatgcattgatgaaattagctacaaaggcttgtgggcctttttttctatctgaaatcgtgtcttcaaattactggaagttgctgatcaaaattgtgggctcttgaattcattctctgattacagatattttaaataagctggtttctataagaacttcaagaaaaaccattttagctgcttaactggcacctttctcaggaagtaataacaccaaatattgctgattcctaggaaaacatttactacttgtaaagaatttcctgagttaaagtagttataacagtttatatacattaaaagtaaggttttactttaaaaaaaaaagtcttgggaataatagctaccatgtattggagtcctttccaggcactattgtatgtactttatatactttatcacatttaatcctcctgtcaatgctttgaggtaggtatgattcccattttatatatgagtaataaaaaaagctcaaggagtttaatcatttatcaagggtttcttctgcgaatgatagagccaggctgcgccgtcggctcctctagcctaacgttggtttacagtattcaaaaagagttgattgaattcaaggttttttttccatgtaaagctatttatatcttccaagcctaatgaaatggatattataaaaatacagttgattcatcctatgtttgggaagagtatttttagtgtaattattttccagcaattgtaagggcatatactgcttgtctcagaagaaaattccacgtagaggggctttaaagtctttatggaaaaaagaaaaataaaaatcatttttcttgttttag

SEQ ID NO: 151966 - DNA, 472 bp, Homo sapiens
  Payload ID: 9916
  Gene Symbol: MTCP1
  Gene Name: mature T-cell proliferation 1
  ENST ID: ENST00000504061
  CDS Start-End: 1-30
ctgttgcttaagcttttgcctgatgactaacctgttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaa

SEQ ID NO: 151967 - DNA, 5937 bp, Homo sapiens
  Payload ID: 9917
  Gene Symbol: MTURN
  Gene Name: maturin, neural progenitor differentiation regulator homolog (Xenopus)
  Uniprot ID: Q8N3F0
  ENST ID: ENST00000324453
  CDS Start-End: 328-723
gggagcgcccaggaaaatccgggcgcccgcgggggtgccggccgctcctcccgccgccccgcgtcccggcccggccgcgccaacccccacggcggcccgcaagggggcggggggaggcggggcggaggaggagccgcgggcgcggcgccgcgctgtccccggccgccgcccgccccactccgcaccgcatgtaaacagtcccagccggcccagcccggccccggaggagcccgcgcaggccgagccgagcgccgcgctgcccgcccgggaggagggcgcctaggagcgggagggcgggcggcggcgggaggcgggcgcggggccgcgatggatttccagcagctggccgacgttgcggagaaatggtgctccaacacgcccttcgagctcatcgccaccgaggagaccgaacgcaggatggatttctacgccgaccccggcgtctccttctatgtgctgtgtccggacaacggctgcggcgacaattttcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactc
